United States Patent
Izhar et al.

(10) Patent No.: US 12,274,758 B2
(45) Date of Patent: Apr. 15, 2025

(54) GUIDE RNA THAT TARGETS A MUTANT HUMAN INOSINE MONOPHOSPHATE DEYHYDROGENASE I ALLELE

(71) Applicant: EmendoBio Inc., Wilmington, DE (US)

(72) Inventors: Lior Izhar, Tel Aviv (IL); David Baram, Nir Zvi (IL); Joe Georgeson, Rehevot (IL); Michal Golan-Mashiach, Ness-Ziona (IL); Asael Herman, Ness-Ziona (IL); Rafi Emmanuel, Ramla (IL)

(73) Assignee: EmendoBio Inc., Wilmington, DE (US)

( * ) Notice: Subject to any disclaimer, the term of this patent is extended or adjusted under 35 U.S.C. 154(b) by 0 days.

(21) Appl. No.: 16/203,056

(22) Filed: Nov. 28, 2018

(65) Prior Publication Data
US 2023/0173107 A1   Jun. 8, 2023

Related U.S. Application Data

(60) Provisional application No. 62/680,481, filed on Jun. 4, 2018, provisional application No. 62/591,344, filed on Nov. 28, 2017.

(51) Int. Cl.
| | |
|---|---|
| *C12N 15/11* | (2006.01) |
| *A61K 48/00* | (2006.01) |
| *A61P 27/00* | (2006.01) |
| *C12N 9/22* | (2006.01) |
| *C12N 15/113* | (2010.01) |

(52) U.S. Cl.
CPC .......... *A61K 48/0066* (2013.01); *A61P 27/00* (2018.01); *C12N 9/22* (2013.01); *C12N 15/11* (2013.01); *C12N 15/1137* (2013.01); *C12Y 301/00* (2013.01)

(58) Field of Classification Search
None
See application file for complete search history.

(56) References Cited

FOREIGN PATENT DOCUMENTS

| WO | WO PCT/US18/62871 | 11/2018 |
|---|---|---|
| WO | WO PCT/US19/23715 | 3/2019 |

OTHER PUBLICATIONS

Jinke (Science, 2012, vol. 337, p. 816-821).*
Gandra (Molecular Vision, 2008, vol. 14, p. 1105-1113).*
Payne (J Med Genetics, 2001, vol. 38, p. 611-647).*
Mukherjee (Eye, 2014, vol. 28, p. 481-487).*
Sun (Ophthalmic Genetics, 2020, vol. 41, No. 6, p. 548-555).*
Browne (Human Mol Genetics, 2002, vol. 11, No. 5, p. 559-568).*
Kennan (Human Mol Genetics, 2002, vol. 11, No. 5, p. 547-558).*
Turk, 2017, "Similar editing efficiency with 2-part and single guide RNA".*
Christie (Mol. Therapy, 2020, vol. 28, No. 8, p. 1846-1857 (Year: 2020).*
U.S. Appl. No. 16/202,955, filed Nov. 28, 2018, Izhar.
U.S. Appl. No. 16/203,004, filed Nov. 28, 2018, Izhar.
U.S. Appl. No. 16/202,867, filed Nov. 28, 2018, zhar.
U.S. Appl. No. 16/203,094, filed Nov. 28, 2018, Izhar.
U.S. Appl. No. 16/203,134, filed Nov. 28, 2018, zhar.
U.S. Appl. No. 16/203,169, filed Nov. 28, 2018, Izhar.
U.S. Appl. No. 16/203,231, filed Nov. 28, 2018, Izhar.
Burstein et al. (2017), "New CRISPR-Cas systems from uncultivated microbes," Nature 542:237-41.
Sentmanat et al. (2018), "A Survey of Validation Strategies for CRISPR-Cas9 Editing," Scientific Reports 8:888, doi:10.1038/s41598-018-19441-8.
Zuris et al. (2015), "Cationic lipid-mediated delivery of proteins enables efficient protein based genome editing in vitro and in vivo," Nat Biotechnol. 33(1):73-80.
Buch et al., "AAV-mediated gene therapy for retinal disorders: from mouse to man" Gene Therapy (2008) 15, 849-857.
Han Z et al. (2012), "Comparative Analysis of DNA Nanoparticles and AAVs for Ocular Gene Delivery" PLoS ONE 7(12): e52189.
Ralph et al., "Gene therapy for neurodegenerative and ocular diseases using lentiviral vectors" Clinical Science (2006), 110, 37-46.
Wang et al. J. "Lipid Nanoparticles for Ocular Gene Therapy" Funct. Biomater. 2015, 6, 379-394.

* cited by examiner

*Primary Examiner* — Michael C Wilson
(74) *Attorney, Agent, or Firm* — Potomac Law Group, PLLC; Jamaica Potts Szeliga

(57) ABSTRACT

RNA molecules comprising a guide sequence portion having 17-20 nucleotides in the sequence of 17-20 contiguous nucleotides set forth in any one of SEQ ID NOs: 1-3010 and compositions, methods, and uses thereof.

6 Claims, No Drawings
Specification includes a Sequence Listing.

GUIDE RNA THAT TARGETS A MUTANT HUMAN INOSINE MONOPHOSPHATE DEYHYDROGENASE I ALLELE

This application claims the benefit of U.S. Provisional Application No. 62/680,481, filed Jun. 4, 2018 and U.S. Provisional Application No. 62/591,344, filed Nov. 28, 2017, the contents of each of which are hereby incorporated by reference.

Throughout this application, various publications are referenced, including referenced in parenthesis. The disclosures of all publications mentioned in this application in their entireties are hereby incorporated by reference into this application in order to provide additional description of the art to which this invention pertains and of the features in the art which can be employed with this invention.

REFERENCE TO SEQUENCE LISTING

This application incorporates-by-reference nucleotide which are present in the filed named "210701 90238-sequences A_SubstituteSequenceListing_DH.txt", which is 552 kilobytes in size, and which was created on Jun. 29, 2021 in the IBM-PC machine format, having an operating system compatibility with MS-Windows, which is contained in the text file filed Jul. 1, 2021 as part of this application.

BACKGROUND OF INVENTION

There are several classes of DNA variation in the human genome, including insertions and deletions, differences in the copy number of repeated sequences, and single nucleotide polymorphisms (SNPs). A SNP is a DNA sequence variation occurring when a single nucleotide (adenine (A), thymine (T), cytosine (C), or guanine (G)) in the genome differs between human subjects or paired chromosomes in an individual. Over the years, the different types of DNA variations have been the focus of the research community either as markers in studies to pinpoint traits or disease causation or as potential causes of genetic disorders.

A genetic disorder is caused by one or more abnormalities in the genome. Genetic disorders may be regarded as either "dominant" or "recessive." Recessive genetic disorders are those which require two copies (i.e., two alleles) of the abnormal/defective gene to be present. In contrast, a dominant genetic disorder involves a gene or genes which exhibit (s) dominance over a normal (functional/healthy) gene or genes. As such, in dominant genetic disorders only a single copy (i.e., allele) of an abnormal gene is required to cause or contribute to the symptoms of a particular genetic disorder. Such mutations include, for example, gain-of-function mutations in which the altered gene product possesses a new molecular function or a new pattern of gene expression. Other examples include dominant negative mutations, which have a gene product that acts antagonistically to the wild-type allele.

Retinitis Pigmentosa

Retinitis pigmentosa (RP) is a clinically and genetically heterogeneous group of inherited degenerative retinal disorders. RP may be inherited in an autosomal dominant, recessive, or x-linked manner and there are multiple genes that, when mutated, may cause the retinitis pigmentosa phenotype. Mutations in the inosine monophosphate dehydrogenase 1 gene (IMPDH1) have been associated with a type 10 form of autosomal dominant retinitis pigmentosa (RP10).

SUMMARY OF THE INVENTION

Disclosed is an approach for knocking out the expression of a dominant-mutated allele by disrupting the dominant-mutated allele or degrading the resulting mRNA.

The present disclosure provides a method for utilizing at least one naturally occurring nucleotide difference or polymorphism (e.g., single nucleotide polymorphism (SNP)) for distinguishing/discriminating between two alleles of a gene, one allele bearing a mutation such that it encodes a mutated protein causing a disease phenotype ("mutated allele"), and the other allele encoding for a functional protein ("functional allele"). In some embodiments, the method further comprises the step of knocking out expression of the mutated protein and allowing expression of the functional protein.

According to embodiments of the present invention, there is provided a first RNA molecule comprising a guide sequence portion having 17-20 nucleotides in the sequence of 17-20 contiguous nucleotides set forth in any one of SEQ ID NOs: 1-3010.

According to embodiments of the present invention, there is provided a first RNA molecule comprising a guide sequence portion having 17-20 contiguous nucleotides set forth in any one of SEQ ID NOs: 1-3010.

According to some embodiments of the present invention, there is provided a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for inactivating a mutant IMDPH1 allele in a cell, the method comprising delivering to the cell a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for treating retinitis pigmentosa, the method comprising delivering to a subject having retinitis pigmentosa a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for inactivating a mutant IMDPH1 allele in a cell, comprising delivering to the cell the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, there is provided a medicament comprising an RNA molecule comprising a guide sequence portion having 17-20 nucleotides in the sequence of 17-20 contiguous nucleotides set forth in any one of SEQ ID NOs: 1-3010 and a CRISPR nuclease for use in inactivating a mutant IMDPH1 allele in a cell, wherein the medicament is administered by delivering to the cell the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for treating ameliorating or preventing retinitis pigmentosa, comprising delivering to a subject having or at risk of having retinitis pigmentosa the composition of comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a medicament comprising the composition comprising an RNA molecule comprising a guide sequence portion having 17-20 nucleotides in the sequence of 17-20 contiguous nucleotides set forth in any one of SEQ ID NOs: 1-3010 and a CRISPR nuclease for use in treating ameliorating or preventing retinitis pigmentosa, wherein the medicament is administered by delivering to a subject having or at risk of having retinitis pigmentosa the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a kit for inactivating a mutant IMDPH1 allele in a cell, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to the cell.

According to some embodiments of the present invention, there is provided a kit for treating retinitis pigmentosa in a subject, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to a subject having or at risk of having retinitis pigmentosa.

DETAILED DESCRIPTION

Definitions

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

It should be understood that the terms "a" and "an" as used above and elsewhere herein refer to "one or more" of the enumerated components. It will be clear to one of ordinary skill in the art that the use of the singular includes the plural unless specifically stated otherwise. Therefore, the terms "a," "an" and "at least one" are used interchangeably in this application.

For purposes of better understanding the present teachings and in no way limiting the scope of the teachings, unless otherwise indicated, all numbers expressing quantities, percentages or proportions, and other numerical values used in the specification and claims, are to be understood as being modified in all instances by the term "about." Accordingly, unless indicated to the contrary, the numerical parameters set forth in the following specification and attached claims are approximations that may vary depending upon the desired properties sought to be obtained. At the very least, each numerical parameter should at least be construed in light of the number of reported significant digits and by applying ordinary rounding techniques.

Unless otherwise stated, adjectives such as "substantially" and "about" modifying a condition or relationship characteristic of a feature or features of an embodiment of the invention, are understood to mean that the condition or characteristic is defined to within tolerances that are acceptable for operation of the embodiment for an application for which it is intended. Unless otherwise indicated, the word "or" in the specification and claims is considered to be the inclusive "or" rather than the exclusive or, and indicates at least one of, or any combination of items it conjoins.

In the description and claims of the present application, each of the verbs, "comprise," "include" and "have" and conjugates thereof, are used to indicate that the object or objects of the verb are not necessarily a complete listing of components, elements or parts of the subject or subjects of the verb. Other terms as used herein are meant to be defined by their well-known meanings in the art.

The "guide sequence portion" of an RNA molecule refers to a nucleotide sequence that is capable of hybridizing to a specific target DNA sequence, e.g., the guide sequence portion has a nucleotide sequence which is fully complementary to said target DNA sequence. In some embodiments, the guide sequence portion is 17, 18, 19, 20, 21, 22, 23, or 24 nucleotides in length, or approximately 17-24, 18-22, 19-22, 18-20, or 17-20 nucleotides in length. The guide sequence portion may be part of an RNA molecule that can form a complex with a CRISPR nuclease with the guide sequence portion serving as the DNA targeting portion of the CRISPR complex. When the DNA molecule having the guide sequence portion is present contemporaneously with the CRISPR molecule the RNA molecule is capable of targeting the CRISPR nuclease to the specific target DNA sequence. Each possibility represents a separate embodiment. An RNA molecule can be custom designed to target any desired sequence.

In embodiments of the present invention, an RNA molecule comprises a guide sequence portion having 17-20 nucleotides in the sequence of 17-20 contiguous nucleotides set forth in any one of SEQ ID NOs: 1-3010, 1-687, or 688-3010.

As used herein, "contiguous nucleotides" set forth in a SEQ ID NO refers to nucleotides in a sequence of nucleotides in the order set forth in the SEQ ID NO without any intervening nucleotides.

In embodiments of the present invention, the guide sequence portion may be 20 nucleotides in length and consists of 20 nucleotides in the sequence of 20 contiguous nucleotides set forth in any one of SEQ ID NOs: 1-3010. In embodiments of the present invention, the guide sequence portion may be less than 20 nucleotides in length. For example, in embodiments of the present invention the guide sequence portion may be 17, 18, or 19 nucleotides in length. In such embodiments the guide sequence portion may consist of 17, 18, or 19 nucleotides, respectively, in the sequence of 17-20 contiguous nucleotides set forth in any one of SEQ ID NOs: 1-3010. For example, a guide sequence portion having 17 nucleotides in the sequence of 17 contiguous nucleotides set forth in SEQ ID NO: 1 may consist of any one of the following nucleotide sequences (nucleotides excluded from the contiguous sequence are marked in strike-through):

```
                                          SEQ ID NO: 1
AGGCUCCACUGAGAGGAAGG 17 nucleotide guide sequence 1:
AGG-CUCCACUGAGAGGAAGG 17 nucleotide guide sequence 2:
AG-GCUCCACUGAGAGGAAG G 17 nucleotide guide sequence 3:
A-GGCUCCACUGAGAGGAA GG 17 nucleotide guide sequence 4:
AGGCUCCACUGAGAGGA AGG
```

In embodiments of the present invention, the guide sequence portion may be greater than 20 nucleotides in length. For example, in embodiments of the present invention the guide sequence portion may be 21, 22, 23, or 24 nucleotides in length. In such embodiments the guide sequence portion comprises 20 nucleotides in the sequence of 20 contiguous nucleotides set forth in any one of SEQ ID NOs: 1-3010 and additional nucleotides fully complimentary to a nucleotide or sequence of nucleotides adjacent to the 3' end of the target sequence, 5' end of the target sequence, or both.

In embodiments of the present invention a CRISPR nuclease and an RNA molecule comprising a guide sequence portion form a CRISPR complex that binds to a target DNA sequence to effect cleavage of the target DNA sequence. CRISPR nucleases, e.g. Cpf1, may form a CRISPR complex comprising a CRISPR nuclease and RNA molecule without a further tracrRNA molecule. Alternatively, CRISPR nucleases, e.g. Cas9, may form a CRISPR complex between the CRISPR nuclease, an RNA molecule, and a tracrRNA molecule.

In embodiments of the present invention, the RNA molecule may further comprise the sequence of a tracrRNA molecule. Such embodiments may be designed as a synthetic fusion of the guide portion of the RNA molecule and the trans-activating crRNA (tracrRNA). (See Jinek (2012) Science). Embodiments of the present invention may also form CRISPR complexes utilizing a separate tracrRNA molecule and a separate RNA molecule comprising a guide sequence portion. In such embodiments the tracrRNA molecule may hybridize with the RNA molecule via basepairing and may be advantageous in certain applications of the invention described herein.

The term "tracr mate sequence" refers to a sequence sufficiently complementary to a tracrRNA molecule so as to hybridize to the tracrRNA via basepairing and promote the formation of a CRISPR complex. (See e.g., U.S. Pat. No. 8,906,616). In embodiments of the present invention, the RNA molecule may further comprise a portion having a tracr mate sequence.

A "gene," for the purposes of the present disclosure, includes a DNA region encoding a gene product, as well as all DNA regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

"Eukaryotic" cells include, but are not limited to, fungal cells (such as yeast), plant cells, animal cells, mammalian cells and human cells.

The term "nuclease" as used herein refers to an enzyme capable of cleaving the phosphodiester bonds between the nucleotide subunits of nucleic acid. A nuclease may be isolated or derived from a natural source. The natural source may be any living organism. Alternatively, a nuclease may be a modified or a synthetic protein which retains the phosphodiester bond cleaving activity. Gene modification can be achieved using a nuclease, for example a CRISPR nuclease.

Embodiments

The present disclosure provides a method for utilizing at least one naturally occurring nucleotide difference or polymorphism (e.g., single nucleotide polymorphism (SNP)) for distinguishing/discriminating between two alleles of a gene, one allele bearing a mutation such that it encodes a mutated protein causing a disease phenotype ("mutated allele"), and the other allele encoding for a functional protein ("functional allele"). The method further comprises the step of knocking out expression of the mutated protein and allowing expression of the functional protein. In some embodiments, the method is for treating, ameliorating, or preventing a dominant negative genetic disorder.

According to embodiments of the present invention, there is provided a first RNA molecule comprising a guide sequence portion having 17-20 nucleotides in the sequence of 17-20 contiguous nucleotides set forth in any one of SEQ ID NOs: 1-3010.

According to embodiments of the present invention, there is provided a first RNA molecule comprising a guide sequence portion having 17-20 contiguous nucleotides set forth in any one of SEQ ID NOs: 1-3010.

According to embodiments of the present invention, an RNA molecule may further comprise a portion having a sequence which binds to a CRISPR nuclease.

According to embodiments of the present invention, the sequence which binds to a CRISPR nuclease is a tracrRNA sequence.

According to embodiments of the present invention, an RNA molecule may further comprise a portion having a tracr mate sequence.

According to embodiments of the present invention, an RNA molecule may further comprise one or more linker portions.

According to embodiments of the present invention, an RNA molecule may be up to 300, 290, 280, 270, 260, 250, 240, 230, 220, 210, 200, 190, 180, 170, 160, 150, 140, 130, 120, 110, or 100 nucleotides in length. Each possibility represents a separate embodiment. In embodiments of the present invention, the RNA molecule may be 17 up to 300 nucleotides in length, 100 up to 300 nucleotides in length, 150 up to 300 nucleotides in length, 200 up to 300 nucleotides in length, 100 to 200 nucleotides in length, or 150 up to 250 nucleotides in length. Each possibility represents a separate embodiment.

According to some embodiments of the present invention, there is provided a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, the composition may comprise a second RNA molecule comprising a guide sequence portion.

According to embodiments of the present invention, the guide sequence portion of the second RNA molecule comprises 17-20 nucleotides in the sequence of 17-20 contiguous nucleotides set forth in any one of SEQ ID NOs: 1-3010.

According to embodiments of the present invention, the 17-20 nucleotides of the guide sequence portion of the second RNA molecule are in a different sequence from the sequence of the guide sequence portion of the first RNA molecule Embodiments of the present invention may comprise a tracrRNA molecule.

According to some embodiments of the present invention, there is provided a method for inactivating a mutant IMDPH1 allele in a cell, the method comprising delivering to the cell a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for treating retinitis pigmentosa, the method comprising delivering to a subject having retinitis pigmentosa a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, the composition comprises a second RNA molecule comprising a guide sequence portion having 17-20 nucleotides in the sequence of 17-20 contiguous nucleotides set forth in any one of SEQ ID NOs: 1-3010.

According to embodiments of the present invention, the 17-20 nucleotides of the guide sequence portion of the second RNA molecule are in a different sequence from the sequence of the guide sequence portion of the first RNA molecule According to embodiments of the present invention, the CRISPR nuclease and the RNA molecule or RNA molecules are delivered to the subject and/or cells substantially at the same time or at different times.

According to embodiments of the present invention, the tracrRNA is delivered to the subject and/or cells substantially at the same time or at different times as the CRISPR nuclease and RNA molecule or RNA molecules.

According to embodiments of the present invention, the first RNA molecule targets a SNP or disease-causing mutation in an exon or promoter of a mutated allele, and wherein the second RNA molecule targets a SNP in the same or a different exon of the mutated allele, a SNP in an intron, or a sequence in an intron present in both the mutated or functional allele.

According to embodiments of the present invention, the first RNA molecule or the first and the second RNA molecules target a SNP in the promoter region, the start codon, or the untranslated region (UTR) of a mutated allele.

According to embodiments of the present invention, the first RNA molecule or the first and the second RNA molecules targets at least a portion of the promoter and/or the start codon and/or a portion of the UTR of a mutated allele.

According to embodiments of the present invention, the first RNA molecule targets a portion of the promoter, a first SNP in the promoter, or a SNP upstream to the promoter of a mutated allele and the second RNA molecule is targets a second SNP, which is downstream of the first SNP, and is in the promoter, in the UTR, or in an intron or in an exon of a mutated allele.

According to embodiments of the present invention, the first RNA molecule targets a SNP in the promoter, upstream of the promoter, or the UTR of a mutated allele and the second RNA molecule is designed to target a sequence which is present in an intron of both the mutated allele and the functional allele.

According to embodiments of the present invention, the first RNA molecule targets a sequence upstream of the promotor which is present in both a mutated and functional allele and the second RNA molecule targets a SNP or disease-causing mutation in any location of the gene.

According to embodiments of the present invention, there is provided a method comprising removing an exon containing a disease-causing mutation from a mutated allele, wherein the first RNA molecule or the first and the second RNA molecules target regions flanking an entire exon or a portion of the exon.

According to embodiments of the present invention, there is provided a method comprising removing multiple exons, the entire open reading frame of a gene, or removing the entire gene.

According to embodiments of the present invention, the first RNA molecule targets a SNP or disease-causing mutation in an exon or promoter of a mutated allele, and wherein the second RNA molecule targets a SNP in the same or a different exon of the mutated allele, a SNP in an intron, or a sequence in an intron present in both the mutated or functional allele.

According to embodiments of the present invention, the first RNA molecule or the first and the second RNA molecules target an alternative splicing signal sequence between an exon and an intron of a mutant allele.

According to embodiments of the present invention, the second RNA molecule targets a sequence present in both a mutated allele and a functional allele.

According to embodiments of the present invention, the second RNA molecule targets an intron.

According to embodiments of the present invention, there is provided a method comprising subjecting the mutant allele to insertion or deletion by an error prone non-homologous end joining (NHEJ) mechanism, generating a frameshift in the mutated allele's sequence.

According to embodiments of the present invention, the frameshift results in inactivation or knockout of the mutated allele.

According to embodiments of the present invention, the frameshift creates an early stop codon in the mutated allele.

According to embodiments of the present invention, the frameshift results in nonsense-mediated mRNA decay of the transcript of the mutant allele.

According to embodiments of the present invention, the inactivating or treating results in a truncated protein encoded by the mutated allele and a functional protein encoded by the functional allele.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease inactivating a mutant IMDPH1 allele in a cell, comprising delivering to the cell the RNA molecule comprising a guide sequence portion having 17-20 nucleotides in the sequence of 17-20 contiguous nucleotides set forth in any one of SEQ ID NOs: 1-3010 and the CRISPR nuclease.

According to embodiments of the present invention, there is provided a medicament comprising an RNA molecule comprising a guide sequence portion having 17-20 nucleotides in the sequence of 17-20 contiguous nucleotides set forth in any one of SEQ ID NOs: 1-3010 and a CRISPR nuclease for use in inactivating a mutant IMDPH1 allele in a cell, wherein the medicament is administered by delivering to the cell the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for treating ameliorating or preventing retinitis pigmentosa, comprising delivering to a subject having or at risk of having retinitis pigmentosa the composition of comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a medicament comprising the composition comprising an RNA molecule comprising a guide sequence portion having 17-20 nucleotides in the sequence of 17-20 contiguous nucleotides set forth in any one of SEQ ID NOs: 1-3010 and a CRISPR nuclease for use in treating ameliorating or preventing retinitis pigmentosa, wherein the medicament is administered by delivering to a subject having or at risk of having retinitis pigmentosa: the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a kit for inactivating a mutant IMDPH1 allele in a cell, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to the cell.

According to some embodiments of the present invention, there is provided a kit for treating retinitis pigmentosa in a subject, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to a subject having or at risk of having retinitis pigmentosa.

In embodiments of the present invention, the RNA molecule comprises a guide sequence portion having 17-20 nucleotides in the sequence of 17-20 contiguous nucleotides set forth in any one of SEQ ID NOs: 1-687, SEQ ID NOs: 688-3010, or SEQ ID NOs 1-3010.

The compositions and methods of the present disclosure may be utilized for treating, preventing, ameliorating, or slowing progression of retinitis pigmentosa. In some embodiments the retinitis pigmentosa is type 10 (RP10).

In some embodiments, a mutated allele is deactivated by delivering to a cell an RNA molecule which targets a SNP in the promoter region, the start codon, or the untranslated region (UTR) of the mutated allele.

In some embodiments, a mutated allele is inactivated by removing at least a portion of the promoter and/or removing the start codon and/or a portion of the UTR. In some embodiments, the method of deactivating a mutated allele comprises removing at least a portion of the promoter. In such embodiments one RNA molecule may be designed for targeting a first SNP in the promoter or upstream to the promoter and another RNA molecule is designed to target a second SNP, which is downstream of the first SNP, and is in the promoter, in the UTR, or in an intron or in an exon. Alternatively, one RNA molecule may be designed for targeting a SNP in the promoter, or upstream of the promoter, or the UTR and another RNA molecule is designed to target a sequence which is present in an intron of both the mutated allele and the functional allele. Alternatively, one RNA molecule may be designed for targeting a sequence upstream of the promotor which is present in both the mutated and functional allele and the other guide is designed to target a SNP or disease-causing mutation in any location of the gene e.g., in an exon, intron, UTR, or downstream of the promoter.

In some embodiments, the method of deactivating a mutated allele comprises an exon skipping step comprising removing an exon containing a disease-causing mutation from the mutated allele. Removing an exon containing a disease-causing mutation in the mutated allele requires two RNA molecules which target regions flanking the entire exon or a portion of the exon. Removal of an exon containing the disease-causing mutation may be designed to eliminate the disease-causing action of the protein while allowing for expression of the remaining protein product which retains some or all of the wild-type activity. As an alternative to single exon skipping, multiple exons, the entire open reading frame or the entire gene can be excised using two RNA molecules flanking the region desired to be excised.

In some embodiments, the method of deactivating a mutated allele comprises delivering two RNA molecules to a cell, wherein one RNA molecule targets a SNP or disease-causing mutation in an exon or promoter of the mutated allele, and wherein the other RNA molecule targets a SNP in the same or a different exon of the mutated allele, a SNP in an intron, or a sequence in an intron present in both the mutated or functional allele.

In some embodiments, an RNA molecule is used to target a CRISPR nuclease to an alternative splicing signal sequence between an exon and an intron of a mutant allele, thereby destroying the alternative splicing signal sequence in the mutant allele.

Any one of, or combination of, the above-mentioned strategies for deactivating a mutant allele may be used in the context of the invention.

Additional strategies may be used to deactivate a mutated allele. For example, in embodiments of the present invention, an RNA molecule is used to direct a CRISPR nuclease to an exon or a splice site of a mutated allele in order to create a double-stranded break (DSB), leading to insertion or deletion of nucleotides by an error-prone non-homologous end-joining (NHEJ) mechanism and formation of a frameshift mutation in the mutated allele. The frameshift mutation may result in: (1) inactivation or knockout of the mutated allele by generation of an early stop codon in the mutated allele, resulting in generation of a truncated protein; or (2) nonsense mediated mRNA decay of the transcript of the mutant allele. In further embodiments, one RNA molecule is used to direct a CRISPR nuclease to a promotor of a mutated allele.

In some embodiments, the method of deactivating a mutated allele further comprises enhancing activity of the functional protein such as by providing a protein/peptide, a nucleic acid encoding a protein/peptide, or a small molecule such as a chemical compound, capable of activating/enhancing activity of the functional protein.

According to some embodiments, the present disclosure provides an RNA sequence ('RNA molecule') which binds to/associates with and/or directs the RNA guided DNA nuclease e.g., CRISPR nuclease to a sequence comprising at least one nucleotide which differs between a mutated allele and a functional allele (e.g., SNP) of a gene of interest (i.e., a sequence of the mutated allele which is not present in the functional allele).

In some embodiments, the method comprises the steps of: contacting a mutated allele of a gene of interest with an allele-specific RNA molecule and a CRISPR nuclease e.g., a Cas9 protein, wherein the allele-specific RNA molecule and the CRISPR nuclease e.g., Cas9 associate with a nucleotide sequence of the mutated allele of the gene of interest which differs by at least one nucleotide from a nucleotide sequence of a functional allele of the gene of interest, thereby modifying or knocking-out the mutated allele.

In some embodiments, the allele-specific RNA molecule and a CRISPR nuclease is introduced to a cell encoding the gene of interest. In some embodiments, the cell encoding the gene of interest is in a mammalian subject. In some embodiments, the cell encoding the gene of interest is in a plant.

In some embodiments, the cleaved mutated allele is further subjected to insertion or deletion (indel) by an error prone non-homologous end joining (NHEJ) mechanism, generating a frameshift in the mutated allele's sequence. In some embodiments, the generated frameshift results in inactivation or knockout of the mutated allele. In some embodiments, the generated frameshift creates an early stop codon in the mutated allele and results in generation of a truncated protein. In such embodiments, the method results in the generation of a truncated protein encoded by the mutated allele and a functional protein encoded by the functional allele. In some embodiments, a frameshift generated in a mutated allele using the methods of the invention results in nonsense-mediated mRNA decay of the transcript of the mutant allele.

In some embodiments, the mutated allele is an allele of the IMDPH1 gene. In some embodiments, the RNA molecule targets a SNP which co-exists with/is genetically linked to the mutated sequence associated with retinitis pigmentosa genetic disorder. In some embodiments, the RNA molecule targets a SNP which is highly prevalent in the population and exists in the mutated allele having the mutated sequence associated with retinitis pigmentosa genetic disorder and not in the functional allele of an individual subject to be treated. In some embodiments, a disease-causing mutation within a mutated IMDPH1 allele is targeted.

In some embodiments, the SNP is within an exon of the gene of interest. In such embodiments, a guide sequence portion of an RNA molecule may be designed to associate with a sequence of the exon of the gene of interest.

In some embodiments, SNP is within an intron or an exon of the gene of interest. In some embodiments, SNP is in close proximity to a splice site between the intron and the exon. In some embodiments, the close proximity to a splice site is 1, 2, 3, 4, 5, 6, 7, 8, 9, 10, 11, 12, 13, 14, 15, 16, 17, 18, 19, or 20 nucleotides upstream or downstream to the splice site. Each possibility represents a separate embodiment of the present invention. In such embodiments, a guide sequence portion of an RNA molecule may be designed to associate with a sequence of the gene of interest which comprises the splice site.

In some embodiments, the method is utilized for treating a subject having a disease phenotype resulting from the heterozygote 1MDPH1 gene. In such embodiments, the method results in improvement, amelioration or prevention of the disease phenotype.

Embodiments referred to above refer to a CRISPR nuclease, RNA molecule(s), and tracrRNA being effective in a subject or cells at the same time. The CRISPR, RNA molecule(s), and tracrRNA can be delivered substantially at the same time or can be delivered at different times but have effect at the same time. For example, this includes delivering the CRISPR nuclease to the subject or cells before the RNA molecule and/or tracr RNA is substantially extant in the subject or cells.

In some embodiments, the cell is a retinal cell. In some embodiments, the cell is a photoreceptor cell. In some embodiments, the photoreceptor cell is a rod photoreceptor cell. In some embodiments, the photoreceptor cell is a cone photoreceptor cell.

Dominant Genetic Disorders.

One of skill in the art will appreciate that all subjects with any type of heterozygote genetic disorder (e.g., dominant genetic disorder) may be subjected to the methods described herein. In one embodiment, the present invention may be used to target a gene involved in, associated with, or causative of dominant genetic disorders such as, for example retinitis pigmentosa. In some embodiments, the dominant genetic disorder is retinitis pigmentosa. In some embodiments, the target gene is the IMPDH1 gene (Entrez Gene, gene ID No: 3614).

CRISPR Nucleases and PAM Recognition

In some embodiments, the sequence specific nuclease is selected from CRISPR nucleases, or a functional variant thereof. In some embodiments, the sequence specific nuclease is an RNA guided DNA nuclease. In such embodiments, the RNA sequence which guides the RNA guided DNA nuclease (e.g., Cpf1) binds to and/or directs the RNA guided DNA nuclease to the sequence comprising at least one nucleotide which differs between a mutated allele and its counterpart functional allele (e.g., SNP). In some embodiments, the CRISPR complex does not further comprise a tracrRNA. In a non-limiting example, in which the RNA guided DNA nuclease is a CRISPR protein, the at least one nucleotide which differs between the dominant mutated allele and the functional allele may be within the PAM site and/or proximal to the PAM site within the region that the RNA molecule is designed to hybridize to. A skilled artisan will appreciate that RNA molecules can be engineered to bind to a target of choice in a genome by commonly known methods in the art.

In embodiments of the present invention, a type II CRISPR system utilizes a mature crRNA:tracrRNA complex directs a CRISPR nuclease, e.g. Cas9, to the target DNA via Watson-Crick base-pairing between the crRNA and the protospacer on the target DNA next to the protospacer adjacent motif (PAM), an additional requirement for target recognition. The CRISPR nuclease then mediates cleavage of target DNA to create a double-stranded break within the protospacer. A skilled artisan will appreciate that each of the engineered RNA molecule of the present invention is further designed such as to associate with a target genomic DNA sequence of interest next to a protospacer adjacent motif (PAM), e.g., a PAM matching the sequence relevant for the type of CRISPR nuclease utilized, such as for a non-limiting example, NGG or NAG, wherein "N" is any nucleobase, for *Streptococcus pyogenes* Cas9 WT (Sp-CAS9); NNGRRT for *Staphylococcus aureus* (SaCas9); NNNVRYM for Jejuni Cas9 WT; NGAN or NGNG for SpCas9-VQR variant; NGCG for SpCas9-VRER variant; NGAG for SpCas9-EQR variant; NNNNGATT for *Neisseria meningitidis* (NmCas9); or TTTV for Cpf1. RNA molecules of the present invention are each designed to form complexes in conjunction with one or more different CRISPR nucleases and designed to target polynucleotide sequences of interest utilizing one or more different PAM sequences respective to the CRISPR nuclease utilized.

In some embodiments, an RNA-guided DNA nuclease e.g., a CRISPR nuclease, may be used to cause a DNA break at a desired location in the genome of a cell. The most commonly used RNA-guided DNA nucleases are derived from CRISPR systems, however, other RNA-guided DNA nucleases are also contemplated for use in the genome editing compositions and methods described herein. For instance, see U.S. Patent Publication No. 2015-0211023, incorporated herein by reference.

CRISPR systems that may be used in the practice of the invention vary greatly. CRISPR systems can be a type I, a type II, or a type III system. Non-limiting examples of suitable CRISPR proteins include Cas3, Cas4, Cas5, Cas5e (or CasD), Cas6, Cas6e, Cas6f, Cas7, Cas8a1, Cas8a2, Cas8b, Cas8c, Cas9, Cas10, Cas10d, CasF, CasG, CasH, Csy1, Csy2, Csy3, Cse1 (or CasA), Cse2 (or CasB), Cse3 (or CasE), Cse4 (or CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3,Csx17, Csx14, Csx10, Csx16, CsaX, Csx3, Csz1, Csx15, Csf1, Csf2, Csf3, Csf4, and Cul966.

In some embodiments, the RNA-guided DNA nuclease is a CRISPR nuclease derived from a type II CRISPR system (e.g., Cas9). The CRISPR nuclease may be derived from *Streptococcus pyogenes, Streptococcus thermophilus, Streptococcus* sp., *Staphylococcus aureus, Neisseria meningitidis, Treponema denticola, Nocardiopsis dassonvillei, Streptomyces pristinaespiralis, Streptomyces viridochromogenes, Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina, Burkholderiales bacterium, Polaromonas naphthalenivorans, Polaromonas* sp., *Crocosphaera watsonii, Cyanothece* sp., *Microcystis aeruginosa, Synechococcus* sp., *Acetohalobium arabaticum, Ammonifex degensii, Caldicelulosiruptor becscii, Candidatus Desulforudis, Clostridium botulinum, Clostridium diljicile, Finegoldia magna, Natranaerobius thermophilus, Pelotomaculum thermopropionicum, Acidithiobacillus caldus, Acidithiobacillus ferrooxidans, Allochromatium vinosum, Marinobacter* sp., *Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Acaryochloris marina*, or any species which encodes a CRISPR nuclease with a known PAM sequence. CRISPR nucleases encoded by uncultured bacteria may also be used in the context of the invention. (See Burstein et al. Nature, 2017). Variants of CRIPSR proteins having known PAM sequences e.g., spCas9 D1135E variant, spCas9 VQR variant, spCas9 EQR variant, or spCas9 VRER variant may also be used in the context of the invention.

Thus, an RNA guided DNA nuclease of a CRISPR system, such as a Cas9 protein or modified Cas9 or homolog or ortholog of Cas9, or other RNA guided DNA nucleases belonging to other types of CRISPR systems, such as Cpf1 and its homologs and orthologs, may be used in the compositions of the present invention.

In certain embodiments, the CRIPSR nuclease may be a "functional derivative" of a naturally occurring Cas protein. A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some cases, the cell does not naturally produce Cas protein and is genetically engineered to produce a Cas protein.

In some embodiments, the CRISPR nuclease is Cpf1. Cpf1 is a single RNA-guided endonuclease which utilizes a T-rich protospacer-adjacent motif. Cpf1 cleaves DNA via a staggered DNA double-stranded break. Two Cpf1 enzymes from Acidaminococcus and Lachnospiraceae have been shown to carry out efficient genome-editing activity in human cells. (See Zetsche et al. (2015) Cell.).

Thus, an RNA guided DNA nuclease of a Type II CRISPR System, such as a Cas9 protein or modified Cas9 or homologs, orthologues, or variants of Cas9, or other RNA guided DNA nucleases belonging to other types of CRISPR systems, such as Cpf1 and its homologs, orthologues, or variants, may be used in the present invention.

In some embodiments, the guide molecule comprises one or more chemical modifications which imparts a new or improved property (e.g., improved stability from degradation, improved hybridization energetics, or improved binding properties with an RNA guided DNA nuclease). Suitable chemical modifications include, but are not limited to: modified bases, modified sugar moieties, or modified internucleoside linkages. Non-limiting examples of suitable chemical modifications include: 4-acetylcytidine, 5-(carboxyhydroxymethyl)uridine, 2'-O-methylcytidine, 5-carboxymethylaminomethyl-2-thiouridine, 5-carboxymethylaminomethyluridine, dihydrouridine, 2'-O-methylpseudouridine, "beta, D-galactosylqueuosine", 2'-O-methylguanosine, inosine, N6-isopentenyladenosine, 1-methyladenosine, 1-methylpseudouridine, 1-methylguanosine, 1-methylinosine, "2,2-dimethylguanosine", 2-methyladenosine, 2-methylguanosine, 3-methylcytidine, 5-methylcytidine, N6-methyladenosine, 7-methylguanosine, 5-methylaminomethyluridine, 5-methoxyaminomethyl-2-thiouridine, "beta, D-mannosylqueuosine", 5-methoxycarbonylmethyl-2-thiouridine, 5-methoxycarbonylmethyluridine, 5-methoxyuridine, 2-methylthio-N6-isopentenyladenosine, N-((9-beta-D-ribofuranosyl-2-methylthiopurine-6-yl)carbamoyl)threonine, N-((9-beta-D-ribofuranosylpurine-6-yl)N-methylcarbamoyl)threonine, uridine-5-oxyacetic acid-methylester, uridine-5-oxyacetic acid, wybutoxosine, queuosine, 2-thiocytidine, 5-methyl-2-thiouridine, 2-thiouridine, 4-thiouridine, 5-methyluridine, N-((9-beta-D-ribofuranosylpurine-6-yl)-carbamoyl)threonine, 2'-O-methyl-5-methyluridine, 2'-O-methyluridine, wybutosine, "3-(3-amino-3-carboxy-propyl)uridine, (acp3) u", 2'-0-methyl (M), 3'-phosphorothioate (MS), 3'-thioPACE (MSP), pseudouridine, or 1-methyl pseudo-uridine. Each possibility represents a separate embodiment of the present invention.

Guide Sequences which Specifically Target a Mutant Allele

A given gene may contain thousands of SNPs. Utilizing a 24 base pair target window for targeting each SNP in a gene would require hundreds of thousands of guide sequences. Any given guide sequence when utilized to target a SNP may result in degradation of the guide sequence, limited activity, no activity, or off-target effects. Accordingly, suitable guide sequences are necessary for targeting a given gene. By the present invention, a novel set of guide sequences have been identified for knocking out expression of a mutated IMDPH1 protein, inactivating a mutant IMDPH1 gene allele, and treating retinitis pigmentosa.

The present disclosure provides guide sequences capable of specifically targeting a mutated allele for inactivation while leaving the functional allele unmodified. The guide sequences of the present invention are designed to, and are most likely to, specifically differentiate between a mutated allele and a functional allele. Of all possible guide sequences which target a mutated allele desired to be inactivated, the specific guide sequences disclosed herein are specifically effective to function with the disclosed embodiments.

Briefly, the guide sequences may have properties as follows: (1) target SNP/insertion/deletion/indel with a high prevalence in the general population, in a specific ethnic population or in a patient population is above 1% and the SNP/insertion/deletion/indel heterozygosity rate in the same population is above 1%; (2) target a location of a SNP/insertion/deletion/indel proximal to a portion of the gene e.g., within 5k bases of any portion of the gene, for example, a promoter, a UTR, an exon or an intron; and (3) target a mutant allele using an RNA molecule which targets a founder or common pathogenic mutations for the disease/gene. In some embodiments, the prevalence of the SNP/insertion/deletion/indel in the general population, in a specific ethnic population or in a patient population is above 1%, 2%, 3%, 4%, 5%, 6%, 7%, 8%, 9%, 10%, 11%, 12%, 13%, 14%, or 15% and the SNP/insertion/deletion/indel heterozygosity rate in the same population is above 1%, 2%, 3%, 4%, 5%, 6%, 7%, 8%, 9%, 10%, 11%, 12%, 13%, 14%, or 15%. Each possibility represents a separate embodiment and may be combined at will.

For each gene, according to SNP/insertion/deletion/indel any one of the following strategies may be used to deactivate the mutated allele: (1) Knockout strategy using one RNA molecule—one RNA molecule is utilized to direct a CRISPR nuclease to a mutated allele and create a double-strand break (DSB) leading to formation of a frameshift mutation in an exon or in a splice site region of the mutated allele; (2) Knockout strategy using two RNA molecules—two RNA molecules are utilized. A first RNA molecule targets a region in the promoter or an upstream region of a mutated allele and another RNA molecule targets downstream of the first RNA molecule in a promoter, exon, or intron of the mutated allele; (3) Exon(s) skipping strategy—one RNA molecule may be used to target a CRISPR nuclease to a splice site region, either at the 5' end of an intron (donor sequence) or the 3' end of an intron (acceptor sequence), in order to destroy the splice site. Alternatively, two RNA molecules may be utilized such that a first RNA molecule targets an upstream region of an exon and a second RNA molecule targets a region downstream of the first RNA molecule, thereby excising the exon(s). Based on the locations of identified SNPs/insertions/deletions/indels for each mutant allele, any one of, or a combination of, the above-mentioned methods to deactivate the mutant allele may be utilized.

When only one RNA molecule is used is that the location of the SNP is in an exon or in close proximity (e.g., within 20 basepairs) to a splice site between the intron and the exon. When two RNA molecules are used, guide sequences may target two SNPs such that the first SNP is upstream of exon 1 e.g., within the 5' untranslated region, or within the promoter or within the first 2 kilobases 5' of the transcription start site, and the second SNP is downstream of the first SNP e.g., within the first 2 kilobases 5' of the transcription start site, or within intron 1, 2 or 3, or within exon 1, exon 2, or exon 3.

Guide sequences of the present invention may target a SNP in the upstream portion of the targeted gene, preferably upstream of the last exon of the targeted gene. Guide sequences may target a SNP upstream to exon 1, for example within the 5' untranslated region, or within the promoter or within the first 4-5 kilobases 5' of the transcription start site.

Guide sequences of the present invention may also target a SNP within close proximity (e.g., within 50 basepairs, more preferably with 20 basepairs) to a known protospacer adjacent motif (PAM) site.

Guide sequences of the present invention also may target: (1) a heterozygous SNP for the targeted gene; (2) a heterozygous SNPs upstream and downstream of the gene; (3) a SNPs with a prevalence of the SNP/insertion/deletion/indel in the general population, in a specific ethnic population, or in a patient population above 1%; (4) have a guanine-cytosine content of greater than 30% and less than 85%; (5) have no repeat of 4 or more thymine/uracil or 8 or more guanine, cytosine, or adenine; (6) having no off-target identified by off-target analysis; and (7) preferably target Exons over Introns or be upstream of a SNP rather than downstream of a SNP.

In embodiments of the present invention, the SNP may be upstream or downstream of the gene. In embodiments of the present invention, the SNP is within 4,000 base pairs upstream or downstream of the gene.

The at least one nucleotide which differs between the mutated allele and the functional allele, may be upstream, downstream or within the sequence of the disease-causing mutation of the gene of interest. The at least one nucleotide which differs between the mutated allele and the functional allele, may be within an exon or within an intron of the gene of interest. In some embodiments, the at least one nucleotide which differs between the mutated allele and the functional allele is within an exon of the gene of interest. In some embodiments, the at least one nucleotide which differs between the mutated allele and the functional allele is within an intron or an exon of the gene of interest, in close proximity to a splice site between the intron and the exon e.g., 1, 2, 3, 4, 5, 6, 7, 8, 9, 10, 11, 12, 13, 14, 15, 16, 17, 18, 19, or 20 nucleotides upstream or downstream to the splice site.

In some embodiments, the at least one nucleotide is a single nucleotide polymorphisms (SNPs). In some embodiments, each of the nucleotide variants of the SNP may be expressed in the mutated allele. In some embodiments, the SNP may be a founder or common pathogenic mutation.

Guide sequences may target a SNP which has both (1) a high prevalence in the general population e.g., above 1% in the population; and (2) a high heterozygosity rate in the population, e.g., above 1%. Guide sequences may target a SNP that is globally distributed. A SNP may be a founder or common pathogenic mutation. In some embodiments, the prevalence in the general population is above 1%, 2%, 3%, 4%, 5%, 6%, 7%, 8%, 9%, 10%, 11%, 12%, 13%, 14%, or 15%. Each possibility represents a separate embodiment. In some embodiments, the heterozygosity rate in the population is above 1%, 2%, 3%, 4%, 5%, 6%, 7%, 8%, 9%, 10%, 11%, 12%, 13%, 14%, or 15%. Each possibility represents a separate embodiment.

In some embodiments, the at least one nucleotide which differs between the mutated allele and the functional allele is linked to/co-exists with the disease-causing mutation in high prevalence in a population. In such embodiments, "high prevalence" refers to at least 92%, 93%, 94%, 95%, 96%, 97%, 98%, 99%, or 100%. Each possibility represents a separate embodiment of the present invention. In one embodiment, the at least one nucleotide which differs between the mutated allele and the functional allele, is a disease-associated mutation. In some embodiments, the SNP is highly prevalent in the population. In such embodiments, "highly prevalent" refers to at least 10%, 11%, 12%, 13%, 14%, 15%, 20%, 30%, 40%, 50%, 60%, or 70% of a population. Each possibility represents a separate embodiment of the present invention.

Guide sequences of the present invention may satisfy any one of the above criteria and are most likely to differentiate between a mutated allele from its corresponding functional allele.

In some embodiments the RNA molecule targets a SNP/WT sequence linked to SNPs as shown in Table 1 below. The SNP details are indicated in the $1^{st}$ column and include: SNP ID No. (based on NCBI's 2018 database of Single Nucleotide Polymorphisms (dbSNP)). For variants with no available rs number variants characteristic are indicated based on gnomAD 2018 browser database. The $2^{nd}$ column indicates an assigned identifier for each SNP. The $3^{rd}$ column indicates the location of each SNP on the IMDPH1 gene.

TABLE 1

IMDPH1 gene SNPs

| RSID | SNP No. | SNP location in the gene |
|---|---|---|
| rs2278293 | s1 | Intron_7 of 16 |
| rs2278294 | s2 | Intron_7 of 16 |
| rs10954183 | s3 | Intron_9 of 16 |

TABLE 1-continued

IMDPH1 gene SNPs

| RSID | SNP No. | SNP location in the gene |
|---|---|---|
| rs10954184 | s4 | Intron_9 of 16 |
| rs7802305 | s5 | Intron_10 of 16 |
| rs72624976 | s6 | Exon_17 of 17 |
| rs34848853 | s7 | Intron_3 of 16 |
| rs13312278 | s8 | Intron_5 of 16 |
| rs13242340 | s9 | Intron_3 of 16 |
| rs3793165 | s10 | Intron_5 of 16 |
| rs11770116 | s11 | Intron_3 of 16 |
| rs12536006 | s12 | Intron_3 of 16 |
| rs2228075 | s13 | Exon_15 of 17 |
| rs6949295 | s14 | downstream +4000 bp |
| rs4731450 | s15 | Intron_5 of 16 |
| rs6948333 | s16 | downstream +574 bp |
| rs2288548 | s17 | Intron_4 of 16 |
| rs4731448 | s18 | Intron_5 of 16 |
| rs2288549 | s19 | Intron_4 of 16 |
| rs714510 | s20 | downstream +1032 bp |
| rs11764599 | s21 | upstream −3349 bp |
| rs11766743 | s22 | Intron_12 of 16 |
| rs3793164 | s23 | Intron_5 of 16 |
| rs2288550 | s24 | Exon_10 of 17 |
| rs72624936 | s25 | Exon_1 of 17 |
| rs11771514 | s26 | upstream −3603 bp |
| rs57124454 | s27 | upstream −1986 bp |
| rs35501542 | s28 | Intron_5 of 16 |
| rs62481103 | s29 | Intron_4 of 16 |
| rs62481100 | s30 | Intron_5 of 16 |
| rs72624928 | s31 | upstream −670 bp |
| rs76672854 | s32 | Intron_4 of 16 |
| rs28580600 | s33 | Intron_13 of 16 |
| rs10247945 | s34 | Intron_5 of 16 |
| rs714511 | s35 | downstream +716 bp |
| rs4731449 | s36 | Intron_5 of 16 |
| rs571143742 | s37 | Intron_3 of 16 |
| rs78763502 | s38 | Intron_16 of 16 |
| rs10273872 | s39 | Intron_16 of 16 |
| rs11761662 | s40 | upstream −381 bp |
| rs11771484 | s41 | upstream −3309 bp |
| rs76951139 | s42 | Intron_5 of 16 |
| rs11769333 | s43 | Intron_3 of 16 |
| rs144398561 | s44 | Intron_3 of 16 |
| rs66511422 | s45 | Intron_3 of 16 |
| rs11766548 | s46 | Intron_3 of 16 |
| rs4731447 | s47 | Intron_14 of 16 |
| rs2288553 | s48 | Intron_1 of 16 |
| rs1803821 | s49 | Exon_17 of 17 |
| rs1803822 | s50 | Exon_17 of 17 |
| rs28364722 | s51 | Intron_3 of 16 |

Delivery to Cells

The RNA molecule compositions described herein may be delivered to a target cell by any suitable means. RNA molecule compositions of the present invention may be targeted to any cell which contains and/or expresses a dominant negative allele, including any mammalian or plant cell. For example, in one embodiment the RNA molecule specifically targets a mutated IMDPH1 allele and the target cell is a retinal cell such as pigment epithelium (RPE), photoreceptors (e.g., rod and cone), glial cells (e.g., Müller), and ganglion cells. Further, the nucleic acid compositions described herein may be delivered as one or more DNA molecules, RNA molecules, Ribonucleoproteins (RNP), nucleic acid vectors, or any combination thereof.

In some embodiments, the RNA molecule comprises a chemical modification. Non-limiting examples of suitable chemical modifications include 2'-0-methyl (M), 2'-0-methyl, 3'phosplaorothioate (MS) or 2'-0-methyl, 3'thio-PACE (MSP), pseudouridine, and 1-methyl pseudo-uridine. Each possibility represents a separate embodiment of the present invention.

Any suitable viral vector system may be used to deliver nucleic acid compositions e.g., the RNA molecule compositions of the subject invention. Conventional viral and non-viral based gene transfer methods can be used to introduce nucleic acids and target tissues. In certain embodiments, nucleic acids are administered for in vivo or ex vivo gene therapy uses. Non-viral vector delivery systems include naked nucleic acid, and nucleic acid complexed with a delivery vehicle such as a liposome or poloxamer. For a review of gene therapy procedures, see Anderson (1992) Science 256:808-813; Nabel & Felgner (1993) TIBTECH 11:211-217; Mitani & Caskey (1993) TIBTECH 11:162-166; Dillon (1993) TIBTECH 11:167-175; Miller (1992) Nature 357:455-460; Van Brunt (1988) Biotechnology 6(10):1149-1154; Vigne (1995) Restorative Neurology and Neuroscience 8:35-36; Kremer & Perricaudet (1995) British Medical Bulletin 51(1):31-44; Haddada et al. (1995) in Current Topics in Microbiology and Immunology Doerfler and Bohm (eds.); and Yu et al. (1994) Gene Therapy 1:13-26.

Methods of non-viral delivery of nucleic acids and/or proteins include electroporation, lipofection, microinjection, biolistics, particle gun acceleration, virosomes, liposomes, immunoliposomes, lipid nanoparticles (LNPs), polycation or lipid:nucleic acid conjugates, artificial virions, and agent-enhanced uptake of nucleic acids or can be delivered to plant cells by bacteria or viruses (e.g., Agrobacterium, Rhizobium sp. NGR234, Sinorhizoboiummeliloti, Mesorhizobium loti, tobacco mosaic virus, potato virus X, cauliflower mosaic virus and cassava vein mosaic virus). (See, e.g., Chung et al. (2006) Trends Plant Sci. 11(1):1-4). Sonoporation using, e.g., the Sonitron 2000 system (Rich-Mar), can also be used for delivery of nucleic acids. Cationic-lipid mediated delivery of proteins and/or nucleic acids is also contemplated as an in vivo or in vitro delivery method. (See Zuris et al. (2015) Nat. Biotechnol. 33(1):73-80; see also Coelho et al. (2013) N. Engl. J. Med. 369, 819-829; Judge et al. (2006) Mol. Ther. 13, 494-505; and Basha et al. (2011) Mol. Ther. 19, 2186-2200).

Additional exemplary nucleic acid delivery systems include those provided by Amaxa® Biosystems (Cologne, Germany), Maxcyte, Inc. (Rockville, Md.), BTX Molecular Delivery Systems (Holliston, Mass.) and Copernicus Therapeutics Inc., (see, e.g., U.S. Pat. No. 6,008,336). Lipofection is described in e.g., U.S. Pat. Nos. 5,049,386, 4,946,787; and 4,897,355, and lipofection reagents are sold commercially (e.g., Transfectam™, Lipofectin™ and Lipofectamine™ RNAiMAX). Cationic and neutral lipids that are suitable for efficient receptor-recognition lipofection of polynucleotides include those of Felgner, WO 91/17424, WO 91/16024. Delivery can be to cells (ex vivo administration) or target tissues (in vivo administration).

The preparation of lipid:nucleic acid complexes, including targeted liposomes such as immunolipid complexes, is well known to one of skill in the art (See, e.g., Crystal (1995) Science 270:404-410; Blaese et al. (1995) Cancer Gene Ther. 2:291-297; Behr et al. (1994) Bioconjugate Chem. 5:382-389; Remy et al. (1994) Bioconjugate Chem. 5:647-654; Gao et al. (1995) Gene Therapy 2:710-722; Ahmad et al. (1992) Cancer Res. 52:4817-4820; U.S. Pat. Nos. 4,186,183, 4,217,344, 4,235,871, 4,261,975, 4,485,054, 4,501,728, 4,774,085, 4,837,028, and 4,946,787).

Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis. Once in the cell, the contents are released (See MacDiarmid et al (2009) Nature Biotechnology 27(7):643).

The use of RNA or DNA viral based systems for viral mediated delivery of nucleic acids take advantage of highly evolved processes for targeting a virus to specific cells in the body and trafficking the viral payload to the nucleus. Viral vectors can be administered directly to patients (in vivo) or they can be used to treat cells in vitro and the modified cells are administered to patients (ex vivo). Conventional viral based systems for the delivery of nucleic acids include, but are not limited to, retroviral, lentivirus, adenoviral, adeno-associated, vaccinia and herpes simplex virus vectors for gene transfer.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system depends on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immunodeficiency virus (SIV), human immunodeficiency virus (HIV), and combinations thereof (See, e.g., Buchschacher et al. (1992) J. Virol. 66:2731-2739; Johann et al. (1992) J. Virol. 66:1635-1640; Sommerfelt et al. (1990) Virol. 176:58-59; Wilson et al. (1989) J. Virol. 63:2374-2378; Miller et al. (1991) J. Virol. 65:2220-2224; PCT/US94/05700).

At least six viral vector approaches are currently available for gene transfer in clinical trials, which utilize approaches that involve complementation of defective vectors by genes inserted into helper cell lines to generate the transducing agent.

pLASN and MFG-S are examples of retroviral vectors that have been used in clinical trials (Dunbar et al. (1995) Blood 85:3048-305; Kohn et al.(1995) Nat. Med. 1:1017-102; Malech et al. (1997) PNAS 94:22 12133-12138). PA317/pLASN was the first therapeutic vector used in a gene therapy trial. (Blaese et al. (1995). Transduction efficiencies of 50% or greater have been observed for MFG-S packaged vectors. (Ellem et al. (1997) Immunol Immunother. 44(1):10-20; Dranoff et al. (1997) Hum. Gene Ther. 1:111-2).

Packaging cells are used to form virus particles that are capable of infecting a host cell. Such cells include 293 cells, which package adenovirus, AAV, and Psi-2 cells or PA317 cells, which package retrovirus. Viral vectors used in gene therapy are usually generated by a producer cell line that packages a nucleic acid vector into a viral particle. The vectors typically contain the minimal viral sequences required for packaging and subsequent integration into a host (if applicable), other viral sequences being replaced by an expression cassette encoding the protein to be expressed. The missing viral functions are supplied in trans by the packaging cell line. For example, AAV vectors used in gene therapy typically only possess inverted terminal repeat (ITR) sequences from the AAV genome which are required for packaging and integration into the host genome. Viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additionally, AAV can be produced at clinical scale using baculovirus systems (see U.S. Pat. No. 7,479,554).

In many gene therapy applications, it is desirable that the gene therapy vector be delivered with a high degree of specificity to a particular tissue type. Accordingly, a viral vector can be modified to have specificity for a given cell type by expressing a ligand as a fusion protein with a viral coat protein on the outer surface of the virus. The ligand is chosen to have affinity for a receptor known to be present on the cell type of interest. For example, Han et al. (1995) Proc. Natl. Acad. Sci. USA 92:9747-9751, reported that Moloney murine leukemia virus can be modified to express human heregulin fused to gp70, and the recombinant virus infects certain human breast cancer cells expressing human epidermal growth factor receptor. This principle can be extended to other virus-target cell pairs, in which the target cell expresses a receptor and the virus expresses a fusion protein comprising a ligand for the cell-surface receptor. For example, filamentous phage can be engineered to display antibody fragments (e.g., FAB or Fv) having specific binding affinity for virtually any chosen cellular receptor. Although the above description applies primarily to viral vectors, the same principles can be applied to nonviral vectors. Such vectors can be engineered to contain specific uptake sequences which favor uptake by specific target cells.

Gene therapy vectors can be delivered in vivo by administration to an individual patient, typically by systemic administration (e.g., intravitreal, intravenous, intraperitoneal, intramuscular, subdermal, or intracranial infusion) or topical application, as described below. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have incorporated the vector.

Ex vivo cell transfection for diagnostics, research, or for gene therapy (e.g., via re-infusion of the transfected cells into the host organism) is well known to those of skill in the art. In a preferred embodiment, cells are isolated from the subject organism, transfected with a nucleic acid composition, and re-infused back into the subject organism (e.g., patient). Various cell types suitable for ex vivo transfection are well known to those of skill in the art (See, e.g., Freshney et al. (1994) Culture of Animal Cells, A Manual of Basic Technique, 3rd ed, and the references cited therein for a discussion of how to isolate and culture cells from patients).

Suitable cells include, but are not limited to, eukaryotic cells and/or cell lines. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NSO, SP2/0-Ag14, HeLa, HEK293 (e.g., HEK293-F, HEK293-H, HEK293-T), perC6 cells, any plant cell (differentiated or undifferentiated), as well as insect cells such as *Spodoptera fugiperda* (Sf), or fungal cells such as *Saccharomyces, Pichia* and *Schizosaccharomyces*. In certain embodiments, the cell line is a CHO-K1, MDCK or HEK293 cell line. Additionally, primary cells may be isolated and used ex vivo for reintroduction into the subject to be treated following treatment with a guided nuclease system (e.g. CRISPR/Cas). Suitable primary cells include peripheral blood mononuclear cells (PBMC), and other blood cell subsets such as, but not limited to, CD4+ T cells or CD8+ T cells. Suitable cells also include stem cells such as, by way of example, embryonic stem cells, induced pluripotent stem cells, hematopoietic stem cells (CD34+), neuronal stem cells and mesenchymal stem cells.

In one embodiment, stem cells are used in ex vivo procedures for cell transfection and gene therapy. The advantage to using stem cells is that they can be differentiated into other cell types in vitro, or can be introduced into a mammal (such as the donor of the cells) where they will engraft in the bone marrow. Methods for differentiating CD34+ cells in vitro into clinically important immune cell types using cytokines such a GM-CSF, IFN-gamma, and TNF-alpha are known (as a non-limiting example see, Inaba et al., J. Exp. Med. 176:1693-1702 (1992)).

Stem cells are isolated for transduction and differentiation using known methods. For example, stem cells are isolated from bone marrow cells by panning the bone marrow cells with antibodies which bind unwanted cells, such as CD4+ and CD8+ (T cells), CD45+ (panB cells), GR-1 (granulocytes), and Tad (differentiated antigen presenting cells) (as a non-limiting example see Inaba et al. (1992) J. Exp. Med. 176:1693-1702). Stem cells that have been modified may also be used in some embodiments.

Any one of the RNA molecule compositions described herein is suitable for genome editing in post-mitotic cells or any cell which is not actively dividing, e.g., arrested cells. Examples of post-mitotic cells which may be edited using a composition of the present invention include, but are not limited to, a photoreceptor cell, a rod photoreceptor cell, a cone photoreceptor cell, a retinal pigment epithelium (RPE), a glial cell, Müller cell, and a ganglion.

Vectors (e.g., retroviruses, liposomes, etc.) containing therapeutic nucleic acid compositions can also be administered directly to an organism for transduction of cells in vivo. Administration is by any of the routes normally used for introducing a molecule into ultimate contact with blood or tissue cells including, but not limited to, injection, infusion, topical application (e.g., eye drops and cream) and electroporation. Suitable methods of administering such nucleic acids are available and well known to those of skill in the art, and, although more than one route can be used to administer a particular composition, a particular route can often provide a more immediate and more effective reaction than another route. According to some embodiments, the composition is delivered via sub-retinal injection. According to some embodiments, the composition is delivered via intravitreal injection.

Vectors suitable for introduction of transgenes into immune cells (e.g., T-cells) include non-integrating lentivirus vectors. See, e.g., U.S. Patent Publication No. 2009-0117617.

Pharmaceutically acceptable carriers are determined in part by the particular composition being administered, as well as by the particular method used to administer the composition. Accordingly, there is a wide variety of suitable formulations of pharmaceutical compositions available, as described below (See, e.g., Remington's Pharmaceutical Sciences, 17th ed., 1989).

In accordance with some embodiments, there is provided an RNA molecule which binds to/associates with and/or directs the RNA guided DNA nuclease to a sequence comprising at least one nucleotide which differs between a mutated allele and a functional allele (e.g., SNP) of a gene of interest (i.e., a sequence of the mutated allele which is not present in the functional allele). The sequence may be within the disease associated mutation. The sequence may be upstream or downstream to the disease associated mutation. Any sequence difference between the mutated allele and the functional allele may be targeted by an RNA molecule of the present invention to inactivate the mutant allele, or otherwise disable its dominant disease-causing effects, while preserving the activity of the functional allele.

The disclosed compositions and methods may also be used in the manufacture of a medicament for treating dominant genetic disorders in a patient.

Examples of RNA Guide Sequences which Specifically Target Mutated Alleles of IMDPH1 Gene Although a large number of guide sequences can be designed to target a mutated allele, the nucleotide sequences described in Tables 2 identified by SEQ ID NOs: 1-3010 below were specifically selected to effectively implement the methods set forth herein and to effectively discriminate between alleles.

Referring to columns 1-4, each of SEQ ID NOs. 1-3010 indicated in column 1 corresponds to an engineered guide sequence. The corresponding SNP details are indicated in column 2. The SNP details indicated in the 2nd column include the assigned identifier for each SNP corresponding to a SNP ID indicated in Table 1. Column 3 indicates whether the target of each guide sequence is the IMDPH1 gene polymorph or wild type (REF) sequence. Column 4 indicates the guanine-cytosine content of each guide sequence.

Table 2 shows guide sequences designed for use as described in the embodiments above to associate with different SNPs within a sequence of a mutated IMDPH1 allele. Each engineered guide molecule is further designed such as to associate with a target genomic DNA sequence of interest that lies next to a protospacer adjacent motif (PAM), e.g., a PAM matching the sequence NGG or NAG, where "N" is any nucleobase. The guide sequences were designed to work in conjunction with one or more different CRISPR nucleases, including, but not limited to, e.g. SpCas9WT (PAM SEQ: NGG), SpCas9.VQR.1 (PAM SEQ: NGAN), SpCas9.VQR.2 (PAM SEQ: NGNG), SpCas9.EQR (PAM SEQ: NGAG), SpCas9.VRER (PAM SEQ: NGCG), SaCas9WT (PAM SEQ: NNGRRT), NmCas9WT (PAM SEQ: NNNNGATT), Cpf1 (PAM SEQ: TTTV), or JeCas9WT (PAM SEQ: NNNVRYM). RNA molecules of the present invention are each designed to form complexes in conjunction with one or more different CRISPR nucleases and designed to target polynucleotide sequences of interest utilizing one or more different PAM sequences respective to the CRISPR nuclease utilized

TABLE 2

Guide sequences designed to associate with specific SNPs of the IMPDH1 gene

| SEQ ID NO: | SNP ID (Table 1) | Target (SNP/REF) | % GC |
|---|---|---|---|
| 1 | s1 | REF | 60% |
| 2 | s1 | SNP | 55% |
| 3 | s1 | REF | 60% |
| 4 | s1 | REF | 60% |
| 5 | s1 | SNP | 55% |
| 6 | s1 | REF | 65% |
| 7 | s1 | SNP | 60% |
| 8 | s1 | SNP | 55% |
| 9 | s1 | REF | 60% |
| 10 | s1 | SNP | 60% |
| 11 | s1 | REF | 65% |
| 12 | s1 | SNP | 50% |
| 13 | s1 | REF | 55% |
| 14 | s1 | REF | 65% |
| 15 | s1 | SNP | 60% |
| 16 | s1 | REF | 75% |
| 17 | s1 | SNP | 70% |
| 18 | s1 | REF | 70% |
| 19 | s1 | SNP | 65% |
| 20 | s1 | SNP | 55% |
| 21 | s1 | REF | 70% |
| 22 | s1 | SNP | 65% |
| 23 | s1 | SNP | 60% |
| 24 | s1 | REF | 65% |
| 25 | s1 | SNP | 50% |
| 26 | s1 | REF | 55% |
| 27 | s2 | SNP | 55% |
| 28 | s2 | REF | 60% |
| 29 | s2 | REF | 60% |
| 30 | s2 | SNP | 55% |
| 31 | s2 | REF | 60% |
| 32 | s2 | SNP | 55% |
| 33 | s2 | REF | 65% |
| 34 | s2 | SNP | 60% |
| 35 | s2 | REF | 60% |
| 36 | s2 | SNP | 55% |
| 37 | s2 | REF | 65% |
| 38 | s2 | SNP | 60% |
| 39 | s2 | SNP | 60% |
| 40 | s2 | REF | 65% |
| 41 | s2 | REF | 60% |
| 42 | s2 | SNP | 55% |
| 43 | s2 | REF | 65% |
| 44 | s2 | SNP | 60% |
| 45 | s2 | SNP | 55% |
| 46 | s2 | REF | 60% |
| 47 | s3 | SNP | 35% |
| 48 | s4 | SNP | 40% |
| 49 | s4 | SNP | 35% |
| 50 | s4 | SNP | 40% |
| 51 | s4 | SNP | 45% |
| 52 | s4 | SNP | 30% |
| 53 | s4 | SNP | 35% |
| 54 | s5 | SNP | 35% |
| 55 | s5 | REF | 40% |
| 56 | s5 | SNP | 55% |
| 57 | s5 | REF | 60% |
| 58 | s6 | SNP | 75% |
| 59 | s6 | REF | 80% |
| 60 | s6 | REF | 80% |
| 61 | s6 | SNP | 75% |
| 62 | s6 | SNP | 75% |
| 63 | s6 | REF | 80% |
| 64 | s6 | REF | 80% |
| 65 | s6 | REF | 80% |
| 66 | s6 | SNP | 75% |
| 67 | s6 | SNP | 80% |
| 68 | s6 | REF | 75% |
| 69 | s6 | REF | 80% |
| 70 | s6 | SNP | 75% |
| 71 | s5 | SNP | 35% |
| 72 | s5 | REF | 40% |
| 73 | s7 | SNP | 65% |
| 74 | s7 | REF | 70% |
| 75 | s7 | REF | 65% |
| 76 | s7 | SNP | 60% |
| 77 | s7 | REF | 65% |
| 78 | s7 | SNP | 60% |
| 79 | s7 | SNP | 65% |
| 80 | s7 | REF | 70% |
| 81 | s7 | REF | 65% |
| 82 | s7 | SNP | 60% |
| 83 | s7 | REF | 70% |
| 84 | s7 | SNP | 65% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 85 | s7 | SNP | 60% |
| 86 | s7 | REF | 70% |
| 87 | s7 | SNP | 65% |
| 88 | s7 | SNP | 70% |
| 89 | s7 | REF | 75% |
| 90 | s7 | REF | 70% |
| 91 | s7 | SNP | 65% |
| 92 | s7 | REF | 70% |
| 93 | s7 | SNP | 65% |
| 94 | s8 | REF | 50% |
| 95 | s8 | SNP | 50% |
| 96 | s8 | SNP | 45% |
| 97 | s8 | REF | 45% |
| 98 | s8 | REF | 50% |
| 99 | s8 | SNP | 50% |
| 100 | s8 | REF | 50% |
| 101 | s8 | SNP | 55% |
| 102 | s8 | REF | 55% |
| 103 | s9 | SNP | 35% |
| 104 | s9 | REF | 40% |
| 105 | s9 | SNP | 40% |
| 106 | s9 | REF | 45% |
| 107 | s9 | SNP | 45% |
| 108 | s9 | REF | 50% |
| 109 | s9 | SNP | 45% |
| 110 | s9 | REF | 50% |
| 111 | s9 | SNP | 45% |
| 112 | s9 | REF | 50% |
| 113 | s9 | REF | 40% |
| 114 | s9 | SNP | 50% |
| 115 | s9 | REF | 55% |
| 116 | s9 | REF | 60% |
| 117 | s9 | REF | 60% |
| 118 | s9 | SNP | 55% |
| 119 | s9 | REF | 50% |
| 120 | s9 | SNP | 45% |
| 121 | s9 | REF | 45% |
| 122 | s9 | SNP | 40% |
| 123 | s9 | SNP | 45% |
| 124 | s9 | REF | 50% |
| 125 | s10 | REF | 70% |
| 126 | s10 | SNP | 65% |
| 127 | s10 | REF | 55% |
| 128 | s10 | SNP | 50% |
| 129 | s10 | REF | 60% |
| 130 | s10 | SNP | 55% |
| 131 | s10 | REF | 65% |
| 132 | s10 | SNP | 60% |
| 133 | s10 | REF | 70% |
| 134 | s10 | SNP | 65% |
| 135 | s10 | REF | 65% |
| 136 | s10 | REF | 65% |
| 137 | s10 | SNP | 60% |
| 138 | s10 | REF | 70% |
| 139 | s10 | SNP | 65% |
| 140 | s10 | REF | 60% |
| 141 | s10 | SNP | 55% |
| 142 | s11 | REF | 55% |
| 143 | s11 | SNP | 60% |
| 144 | s11 | REF | 65% |
| 145 | s11 | SNP | 70% |
| 146 | s11 | SNP | 65% |
| 147 | s11 | REF | 60% |
| 148 | s11 | REF | 60% |
| 149 | s11 | SNP | 65% |
| 150 | s11 | REF | 60% |
| 151 | s11 | SNP | 65% |
| 152 | s11 | REF | 60% |
| 153 | s12 | SNP | 50% |
| 154 | s12 | SNP | 50% |
| 155 | s12 | SNP | 65% |
| 156 | s12 | REF | 70% |
| 157 | s12 | SNP | 50% |
| 158 | s12 | SNP | 50% |
| 159 | s13 | REF | 45% |
| 160 | s13 | REF | 45% |
| 161 | s13 | REF | 50% |
| 162 | s15 | SNP | 35% |
| 163 | s15 | REF | 40% |
| 164 | s15 | REF | 30% |
| 165 | s15 | REF | 35% |
| 166 | s15 | SNP | 30% |
| 167 | s15 | REF | 35% |
| 168 | s15 | REF | 30% |
| 169 | s17 | SNP | 35% |
| 170 | s17 | REF | 30% |
| 171 | s17 | SNP | 40% |
| 172 | s17 | REF | 35% |
| 173 | s17 | SNP | 50% |
| 174 | s17 | REF | 45% |
| 175 | s17 | REF | 30% |
| 176 | s17 | SNP | 35% |
| 177 | s17 | REF | 30% |
| 178 | s17 | SNP | 35% |
| 179 | s17 | REF | 35% |
| 180 | s17 | SNP | 40% |
| 181 | s17 | REF | 30% |
| 182 | s17 | SNP | 35% |
| 183 | s17 | SNP | 35% |
| 184 | s17 | REF | 30% |
| 185 | s17 | REF | 30% |
| 186 | s17 | REF | 30% |
| 187 | s18 | SNP | 40% |
| 188 | s18 | REF | 35% |
| 189 | s18 | REF | 35% |
| 190 | s18 | SNP | 40% |
| 191 | s18 | SNP | 35% |
| 192 | s18 | REF | 30% |
| 193 | s18 | REF | 30% |
| 194 | s18 | SNP | 35% |
| 195 | s18 | REF | 30% |
| 196 | s18 | SNP | 35% |
| 197 | s18 | SNP | 35% |
| 198 | s18 | SNP | 35% |
| 199 | s18 | REF | 30% |
| 200 | s19 | REF | 45% |
| 201 | s19 | SNP | 50% |
| 202 | s19 | REF | 45% |
| 203 | s19 | SNP | 50% |
| 204 | s19 | REF | 50% |
| 205 | s19 | SNP | 55% |
| 206 | s19 | REF | 50% |
| 207 | s19 | REF | 50% |
| 208 | s19 | SNP | 55% |
| 209 | s19 | SNP | 50% |
| 210 | s19 | REF | 45% |
| 211 | s19 | REF | 60% |
| 212 | s19 | SNP | 65% |
| 213 | s19 | SNP | 55% |
| 214 | s19 | REF | 55% |
| 215 | s19 | SNP | 60% |
| 216 | s19 | REF | 50% |
| 217 | s19 | SNP | 55% |
| 218 | s19 | SNP | 55% |
| 219 | s19 | REF | 50% |
| 220 | s21 | SNP | 40% |
| 221 | s21 | REF | 35% |
| 222 | s21 | SNP | 40% |
| 223 | s22 | SNP | 50% |
| 224 | s22 | REF | 30% |
| 225 | s22 | REF | 45% |
| 226 | s22 | SNP | 50% |
| 227 | s22 | REF | 45% |
| 228 | s22 | REF | 45% |
| 229 | s22 | SNP | 50% |
| 230 | s23 | SNP | 70% |
| 231 | s23 | REF | 70% |
| 232 | s23 | SNP | 75% |
| 233 | s23 | SNP | 75% |
| 234 | s23 | REF | 70% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 235 | s23 | REF | 65% |
| 236 | s23 | SNP | 70% |
| 237 | s23 | REF | 65% |
| 238 | s23 | SNP | 70% |
| 239 | s23 | REF | 70% |
| 240 | s23 | SNP | 75% |
| 241 | s23 | REF | 65% |
| 242 | s23 | REF | 60% |
| 243 | s23 | SNP | 65% |
| 244 | s23 | SNP | 70% |
| 245 | s23 | SNP | 65% |
| 246 | s23 | REF | 60% |
| 247 | s24 | SNP | 65% |
| 248 | s24 | SNP | 55% |
| 249 | s24 | REF | 55% |
| 250 | s25 | REF | 75% |
| 251 | s25 | REF | 75% |
| 252 | s25 | SNP | 80% |
| 253 | s25 | SNP | 80% |
| 254 | s25 | REF | 75% |
| 255 | s25 | REF | 80% |
| 256 | s25 | SNP | 80% |
| 257 | s25 | SNP | 80% |
| 258 | s25 | REF | 75% |
| 259 | s25 | SNP | 80% |
| 260 | s25 | REF | 75% |
| 261 | s25 | REF | 75% |
| 262 | s25 | SNP | 80% |
| 263 | s25 | SNP | 80% |
| 264 | s25 | REF | 75% |
| 265 | s25 | REF | 75% |
| 266 | s25 | SNP | 80% |
| 267 | s25 | REF | 75% |
| 268 | s25 | SNP | 80% |
| 269 | s25 | SNP | 80% |
| 270 | s25 | REF | 75% |
| 271 | s25 | REF | 80% |
| 272 | s24 | REF | 60% |
| 273 | s24 | SNP | 60% |
| 274 | s24 | REF | 60% |
| 275 | s24 | REF | 60% |
| 276 | s24 | REF | 60% |
| 277 | s24 | REF | 65% |
| 278 | s24 | SNP | 65% |
| 279 | s24 | REF | 65% |
| 280 | s24 | SNP | 55% |
| 281 | s24 | SNP | 70% |
| 282 | s24 | REF | 60% |
| 283 | s26 | SNP | 45% |
| 284 | s26 | SNP | 55% |
| 285 | s26 | SNP | 45% |
| 286 | s26 | SNP | 50% |
| 287 | s26 | SNP | 50% |
| 288 | s26 | SNP | 50% |
| 289 | s26 | SNP | 55% |
| 290 | s26 | SNP | 45% |
| 291 | s26 | SNP | 55% |
| 292 | s27 | REF | 65% |
| 293 | s27 | REF | 60% |
| 294 | s28 | REF | 60% |
| 295 | s28 | SNP | 55% |
| 296 | s28 | REF | 70% |
| 297 | s28 | SNP | 65% |
| 298 | s28 | REF | 55% |
| 299 | s28 | SNP | 50% |
| 300 | s28 | SNP | 60% |
| 301 | s28 | REF | 65% |
| 302 | s28 | REF | 50% |
| 303 | s28 | SNP | 45% |
| 304 | s28 | REF | 50% |
| 305 | s28 | SNP | 45% |
| 306 | s29 | REF | 65% |
| 307 | s29 | SNP | 60% |
| 308 | s29 | REF | 55% |
| 309 | s29 | SNP | 50% |
| 310 | s29 | REF | 55% |
| 311 | s29 | SNP | 50% |
| 312 | s29 | REF | 60% |
| 313 | s29 | SNP | 55% |
| 314 | s29 | REF | 55% |
| 315 | s29 | SNP | 50% |
| 316 | s29 | REF | 55% |
| 317 | s29 | SNP | 50% |
| 318 | s29 | SNP | 55% |
| 319 | s29 | REF | 60% |
| 320 | s29 | SNP | 50% |
| 321 | s29 | REF | 55% |
| 322 | s29 | REF | 60% |
| 323 | s29 | SNP | 55% |
| 324 | s29 | REF | 55% |
| 325 | s29 | SNP | 50% |
| 326 | s29 | REF | 60% |
| 327 | s29 | SNP | 55% |
| 328 | s29 | SNP | 65% |
| 329 | s29 | REF | 70% |
| 330 | s29 | SNP | 65% |
| 331 | s29 | REF | 70% |
| 332 | s29 | REF | 60% |
| 333 | s29 | SNP | 55% |
| 334 | s30 | REF | 65% |
| 335 | s30 | SNP | 60% |
| 336 | s30 | REF | 65% |
| 337 | s30 | SNP | 60% |
| 338 | s30 | REF | 65% |
| 339 | s30 | REF | 65% |
| 340 | s30 | SNP | 60% |
| 341 | s30 | REF | 65% |
| 342 | s30 | REF | 60% |
| 343 | s30 | SNP | 55% |
| 344 | s30 | REF | 60% |
| 345 | s30 | REF | 70% |
| 346 | s30 | SNP | 55% |
| 347 | s31 | SNP | 35% |
| 348 | s31 | SNP | 35% |
| 349 | s31 | SNP | 35% |
| 350 | s31 | SNP | 30% |
| 351 | s31 | SNP | 30% |
| 352 | s31 | SNP | 45% |
| 353 | s31 | SNP | 35% |
| 354 | s31 | SNP | 35% |
| 355 | s31 | SNP | 30% |
| 356 | s31 | SNP | 35% |
| 357 | s31 | SNP | 30% |
| 358 | s31 | SNP | 35% |
| 359 | s31 | REF | 40% |
| 360 | s32 | SNP | 60% |
| 361 | s32 | REF | 65% |
| 362 | s32 | SNP | 55% |
| 363 | s32 | REF | 60% |
| 364 | s32 | REF | 65% |
| 365 | s32 | SNP | 60% |
| 366 | s32 | SNP | 60% |
| 367 | s32 | REF | 65% |
| 368 | s32 | SNP | 55% |
| 369 | s32 | REF | 60% |
| 370 | s32 | REF | 70% |
| 371 | s32 | SNP | 65% |
| 372 | s32 | SNP | 50% |
| 373 | s32 | REF | 55% |
| 374 | s32 | SNP | 55% |
| 375 | s32 | REF | 60% |
| 376 | s32 | REF | 65% |
| 377 | s32 | SNP | 60% |
| 378 | s33 | REF | 70% |
| 379 | s33 | SNP | 65% |
| 380 | s33 | REF | 70% |
| 381 | s33 | SNP | 65% |
| 382 | s33 | REF | 70% |
| 383 | s33 | REF | 70% |
| 384 | s33 | SNP | 65% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 385 | s33 | REF | 75% |
| 386 | s33 | REF | 70% |
| 387 | s33 | SNP | 65% |
| 388 | s33 | SNP | 70% |
| 389 | s33 | REF | 75% |
| 390 | s33 | REF | 75% |
| 391 | s33 | REF | 70% |
| 392 | s33 | SNP | 65% |
| 393 | s33 | REF | 70% |
| 394 | s33 | REF | 75% |
| 395 | s33 | SNP | 70% |
| 396 | s33 | REF | 75% |
| 397 | s33 | REF | 75% |
| 398 | s33 | SNP | 70% |
| 399 | s33 | SNP | 70% |
| 400 | s33 | SNP | 70% |
| 401 | s33 | REF | 70% |
| 402 | s33 | SNP | 65% |
| 403 | s34 | SNP | 30% |
| 404 | s34 | REF | 35% |
| 405 | s34 | SNP | 35% |
| 406 | s34 | REF | 40% |
| 407 | s34 | REF | 50% |
| 408 | s34 | SNP | 45% |
| 409 | s34 | SNP | 40% |
| 410 | s34 | REF | 45% |
| 411 | s34 | REF | 50% |
| 412 | s34 | SNP | 45% |
| 413 | s34 | SNP | 35% |
| 414 | s34 | REF | 40% |
| 415 | s34 | SNP | 45% |
| 416 | s34 | REF | 50% |
| 417 | s34 | SNP | 45% |
| 418 | s34 | SNP | 45% |
| 419 | s34 | REF | 50% |
| 420 | s36 | REF | 55% |
| 421 | s36 | SNP | 60% |
| 422 | s36 | SNP | 40% |
| 423 | s36 | SNP | 45% |
| 424 | s36 | REF | 40% |
| 425 | s36 | SNP | 55% |
| 426 | s36 | REF | 50% |
| 427 | s36 | REF | 50% |
| 428 | s36 | SNP | 55% |
| 429 | s36 | SNP | 45% |
| 430 | s36 | REF | 55% |
| 431 | s36 | REF | 45% |
| 432 | s36 | REF | 60% |
| 433 | s36 | SNP | 65% |
| 434 | s36 | SNP | 60% |
| 435 | s36 | REF | 55% |
| 436 | s36 | SNP | 50% |
| 437 | s36 | SNP | 60% |
| 438 | s36 | REF | 55% |
| 439 | s36 | REF | 55% |
| 440 | s36 | SNP | 60% |
| 441 | s37 | SNP | 75% |
| 442 | s37 | SNP | 75% |
| 443 | s37 | SNP | 70% |
| 444 | s37 | SNP | 75% |
| 445 | s37 | SNP | 75% |
| 446 | s37 | REF | 75% |
| 447 | s37 | SNP | 80% |
| 448 | s37 | SNP | 75% |
| 449 | s37 | REF | 75% |
| 450 | s37 | SNP | 80% |
| 451 | s37 | SNP | 75% |
| 452 | s37 | SNP | 75% |
| 453 | s37 | SNP | 70% |
| 454 | s37 | SNP | 70% |
| 455 | s37 | SNP | 70% |
| 456 | s38 | SNP | 60% |
| 457 | s38 | REF | 60% |
| 458 | s38 | REF | 45% |
| 459 | s38 | REF | 45% |
| 460 | s38 | SNP | 45% |
| 461 | s38 | SNP | 45% |
| 462 | s38 | REF | 45% |
| 463 | s38 | SNP | 60% |
| 464 | s38 | REF | 60% |
| 465 | s38 | SNP | 50% |
| 466 | s38 | REF | 50% |
| 467 | s38 | REF | 60% |
| 468 | s38 | SNP | 60% |
| 469 | s38 | REF | 55% |
| 470 | s38 | SNP | 55% |
| 471 | s38 | REF | 50% |
| 472 | s38 | SNP | 60% |
| 473 | s38 | REF | 60% |
| 474 | s38 | SNP | 65% |
| 475 | s38 | SNP | 50% |
| 476 | s38 | REF | 45% |
| 477 | s38 | SNP | 45% |
| 478 | s38 | SNP | 55% |
| 479 | s38 | REF | 55% |
| 480 | s39 | SNP | 75% |
| 481 | s39 | REF | 80% |
| 482 | s39 | SNP | 75% |
| 483 | s39 | REF | 75% |
| 484 | s39 | REF | 80% |
| 485 | s39 | SNP | 70% |
| 486 | s39 | REF | 75% |
| 487 | s39 | REF | 75% |
| 488 | s39 | SNP | 70% |
| 489 | s39 | REF | 70% |
| 490 | s39 | SNP | 65% |
| 491 | s39 | SNP | 70% |
| 492 | s39 | REF | 75% |
| 493 | s39 | SNP | 75% |
| 494 | s39 | REF | 80% |
| 495 | s39 | REF | 70% |
| 496 | s39 | SNP | 70% |
| 497 | s39 | REF | 80% |
| 498 | s39 | SNP | 65% |
| 499 | s39 | SNP | 70% |
| 500 | s39 | REF | 75% |
| 501 | s39 | SNP | 75% |
| 502 | s39 | REF | 75% |
| 503 | s39 | SNP | 70% |
| 504 | s39 | REF | 80% |
| 505 | s39 | SNP | 65% |
| 506 | s39 | REF | 70% |
| 507 | s39 | SNP | 70% |
| 508 | s39 | REF | 75% |
| 509 | s39 | REF | 70% |
| 510 | s39 | SNP | 65% |
| 511 | s39 | SNP | 70% |
| 512 | s39 | REF | 75% |
| 513 | s39 | SNP | 70% |
| 514 | s39 | REF | 75% |
| 515 | s40 | SNP | 75% |
| 516 | s40 | REF | 70% |
| 517 | s40 | REF | 70% |
| 518 | s40 | SNP | 75% |
| 519 | s40 | SNP | 75% |
| 520 | s40 | REF | 70% |
| 521 | s40 | SNP | 75% |
| 522 | s40 | REF | 70% |
| 523 | s40 | REF | 70% |
| 524 | s40 | SNP | 75% |
| 525 | s40 | REF | 70% |
| 526 | s40 | SNP | 75% |
| 527 | s40 | REF | 70% |
| 528 | s40 | SNP | 75% |
| 529 | s40 | SNP | 75% |
| 530 | s40 | REF | 70% |
| 531 | s40 | REF | 70% |
| 532 | s40 | SNP | 70% |
| 533 | s40 | REF | 65% |
| 534 | s40 | SNP | 70% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 535 | s40 | REF | 65% |
| 536 | s40 | SNP | 65% |
| 537 | s40 | REF | 60% |
| 538 | s40 | SNP | 70% |
| 539 | s40 | REF | 65% |
| 540 | s40 | REF | 65% |
| 541 | s40 | SNP | 70% |
| 542 | s41 | SNP | 35% |
| 543 | s42 | REF | 50% |
| 544 | s42 | SNP | 55% |
| 545 | s42 | SNP | 30% |
| 546 | s42 | REF | 40% |
| 547 | s42 | SNP | 45% |
| 548 | s42 | REF | 45% |
| 549 | s42 | SNP | 50% |
| 550 | s42 | REF | 45% |
| 551 | s42 | SNP | 50% |
| 552 | s42 | SNP | 50% |
| 553 | s42 | REF | 45% |
| 554 | s42 | SNP | 50% |
| 555 | s42 | REF | 45% |
| 556 | s42 | SNP | 50% |
| 557 | s42 | REF | 45% |
| 558 | s43 | REF | 55% |
| 559 | s43 | SNP | 60% |
| 560 | s43 | REF | 55% |
| 561 | s43 | REF | 65% |
| 562 | s43 | SNP | 70% |
| 563 | s43 | REF | 50% |
| 564 | s43 | SNP | 55% |
| 565 | s43 | SNP | 60% |
| 566 | s43 | SNP | 60% |
| 567 | s43 | REF | 55% |
| 568 | s43 | SNP | 60% |
| 569 | s43 | REF | 55% |
| 570 | s43 | REF | 60% |
| 571 | s43 | SNP | 65% |
| 572 | s43 | SNP | 55% |
| 573 | s43 | REF | 50% |
| 574 | s43 | REF | 55% |
| 575 | s43 | SNP | 60% |
| 576 | s43 | SNP | 70% |
| 577 | s43 | REF | 65% |
| 578 | s44 | SNP | 45% |
| 579 | s44 | REF | 55% |
| 580 | s44 | SNP | 60% |
| 581 | s44 | REF | 50% |
| 582 | s44 | SNP | 55% |
| 583 | s44 | REF | 60% |
| 584 | s44 | REF | 60% |
| 585 | s44 | REF | 60% |
| 586 | s44 | REF | 55% |
| 587 | s44 | REF | 60% |
| 588 | s44 | REF | 60% |
| 589 | s44 | REF | 55% |
| 590 | s45 | SNP | 65% |
| 591 | s45 | REF | 75% |
| 592 | s45 | REF | 75% |
| 593 | s45 | REF | 75% |
| 594 | s45 | SNP | 70% |
| 595 | s45 | REF | 80% |
| 596 | s45 | REF | 75% |
| 597 | s45 | SNP | 75% |
| 598 | s45 | REF | 75% |
| 599 | s45 | SNP | 70% |
| 600 | s45 | REF | 75% |
| 601 | s45 | SNP | 70% |
| 602 | s45 | REF | 80% |
| 603 | s45 | SNP | 75% |
| 604 | s45 | REF | 75% |
| 605 | s45 | REF | 70% |
| 606 | s45 | REF | 75% |
| 607 | s45 | SNP | 70% |
| 608 | s45 | REF | 70% |
| 609 | s45 | SNP | 65% |
| 610 | s45 | REF | 75% |
| 611 | s46 | REF | 60% |
| 612 | s46 | SNP | 55% |
| 613 | s46 | REF | 60% |
| 614 | s46 | REF | 65% |
| 615 | s46 | REF | 70% |
| 616 | s46 | SNP | 65% |
| 617 | s46 | SNP | 65% |
| 618 | s46 | REF | 70% |
| 619 | s46 | SNP | 70% |
| 620 | s46 | REF | 75% |
| 621 | s46 | REF | 75% |
| 622 | s46 | SNP | 70% |
| 623 | s46 | REF | 70% |
| 624 | s46 | SNP | 65% |
| 625 | s46 | REF | 70% |
| 626 | s46 | SNP | 65% |
| 627 | s46 | REF | 70% |
| 628 | s46 | SNP | 65% |
| 629 | s46 | REF | 70% |
| 630 | s46 | SNP | 65% |
| 631 | s47 | REF | 65% |
| 632 | s47 | SNP | 70% |
| 633 | s47 | REF | 70% |
| 634 | s47 | SNP | 60% |
| 635 | s47 | REF | 55% |
| 636 | s47 | REF | 75% |
| 637 | s47 | REF | 75% |
| 638 | s47 | SNP | 60% |
| 639 | s47 | REF | 55% |
| 640 | s47 | REF | 75% |
| 641 | s47 | SNP | 80% |
| 642 | s47 | SNP | 80% |
| 643 | s47 | REF | 75% |
| 644 | s47 | SNP | 65% |
| 645 | s47 | REF | 60% |
| 646 | s47 | SNP | 80% |
| 647 | s47 | REF | 75% |
| 648 | s47 | SNP | 80% |
| 649 | s47 | REF | 65% |
| 650 | s47 | SNP | 70% |
| 651 | s47 | REF | 60% |
| 652 | s47 | SNP | 65% |
| 653 | s47 | SNP | 80% |
| 654 | s47 | REF | 75% |
| 655 | s47 | SNP | 80% |
| 656 | s47 | REF | 60% |
| 657 | s48 | REF | 55% |
| 658 | s48 | SNP | 55% |
| 659 | s48 | REF | 55% |
| 660 | s49 | REF | 60% |
| 661 | s49 | REF | 60% |
| 662 | s49 | REF | 70% |
| 663 | s49 | REF | 70% |
| 664 | s49 | REF | 65% |
| 665 | s50 | REF | 60% |
| 666 | s50 | SNP | 55% |
| 667 | s50 | REF | 60% |
| 668 | s50 | SNP | 55% |
| 669 | s50 | SNP | 50% |
| 670 | s50 | REF | 55% |
| 671 | s48 | SNP | 55% |
| 672 | s48 | SNP | 55% |
| 673 | s48 | REF | 55% |
| 674 | s48 | SNP | 50% |
| 675 | s48 | REF | 50% |
| 676 | s48 | SNP | 45% |
| 677 | s48 | REF | 45% |
| 678 | s48 | REF | 70% |
| 679 | s48 | SNP | 45% |
| 680 | s48 | REF | 45% |
| 681 | s51 | SNP | 60% |
| 682 | s51 | REF | 55% |
| 683 | s51 | SNP | 55% |
| 684 | s51 | REF | 50% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 685 | s51 | REF | 55% |
| 686 | s51 | SNP | 60% |
| 687 | s51 | SNP | 55% |
| 688 | s1 | REF | 55% |
| 689 | s1 | SNP | 50% |
| 690 | s1 | SNP | 75% |
| 691 | s1 | SNP | 65% |
| 692 | s1 | REF | 70% |
| 693 | s1 | SNP | 65% |
| 694 | s1 | REF | 70% |
| 695 | s1 | REF | 60% |
| 696 | s1 | REF | 65% |
| 697 | s1 | SNP | 60% |
| 698 | s1 | SNP | 60% |
| 699 | s1 | REF | 65% |
| 700 | s1 | REF | 70% |
| 701 | s1 | SNP | 65% |
| 702 | s1 | SNP | 55% |
| 703 | s1 | REF | 60% |
| 704 | s1 | SNP | 55% |
| 705 | s1 | SNP | 65% |
| 706 | s1 | REF | 70% |
| 707 | s1 | REF | 55% |
| 708 | s1 | REF | 70% |
| 709 | s1 | SNP | 65% |
| 710 | s1 | SNP | 55% |
| 711 | s1 | REF | 60% |
| 712 | s1 | REF | 60% |
| 713 | s1 | SNP | 55% |
| 714 | s1 | REF | 80% |
| 715 | s1 | REF | 60% |
| 716 | s1 | REF | 75% |
| 717 | s1 | SNP | 70% |
| 718 | s1 | SNP | 55% |
| 719 | s1 | REF | 80% |
| 720 | s1 | SNP | 75% |
| 721 | s1 | SNP | 70% |
| 722 | s1 | REF | 75% |
| 723 | s1 | SNP | 50% |
| 724 | s1 | REF | 55% |
| 725 | s1 | SNP | 70% |
| 726 | s1 | SNP | 65% |
| 727 | s1 | REF | 70% |
| 728 | s1 | REF | 55% |
| 729 | s1 | SNP | 55% |
| 730 | s1 | REF | 60% |
| 731 | s1 | SNP | 55% |
| 732 | s1 | REF | 60% |
| 733 | s1 | SNP | 50% |
| 734 | s1 | REF | 75% |
| 735 | s1 | SNP | 50% |
| 736 | s1 | REF | 55% |
| 737 | s2 | REF | 65% |
| 738 | s2 | REF | 60% |
| 739 | s2 | REF | 60% |
| 740 | s2 | SNP | 55% |
| 741 | s2 | SNP | 55% |
| 742 | s2 | REF | 60% |
| 743 | s2 | SNP | 60% |
| 744 | s2 | REF | 65% |
| 745 | s2 | SNP | 55% |
| 746 | s2 | SNP | 55% |
| 747 | s2 | SNP | 55% |
| 748 | s2 | REF | 60% |
| 749 | s2 | REF | 60% |
| 750 | s2 | SNP | 55% |
| 751 | s2 | SNP | 60% |
| 752 | s2 | REF | 65% |
| 753 | s2 | SNP | 60% |
| 754 | s2 | REF | 65% |
| 755 | s2 | SNP | 60% |
| 756 | s2 | REF | 65% |
| 757 | s2 | REF | 65% |
| 758 | s2 | SNP | 55% |
| 759 | s2 | REF | 60% |
| 760 | s2 | SNP | 55% |
| 761 | s2 | REF | 60% |
| 762 | s2 | SNP | 55% |
| 763 | s2 | REF | 60% |
| 764 | s2 | REF | 65% |
| 765 | s2 | SNP | 60% |
| 766 | s2 | REF | 65% |
| 767 | s2 | SNP | 60% |
| 768 | s2 | REF | 60% |
| 769 | s2 | SNP | 60% |
| 770 | s2 | REF | 65% |
| 771 | s2 | SNP | 55% |
| 772 | s2 | SNP | 60% |
| 773 | s2 | REF | 65% |
| 774 | s2 | SNP | 60% |
| 775 | s2 | SNP | 60% |
| 776 | s2 | REF | 65% |
| 777 | s2 | REF | 65% |
| 778 | s2 | SNP | 60% |
| 779 | s2 | REF | 65% |
| 780 | s2 | SNP | 60% |
| 781 | s2 | SNP | 60% |
| 782 | s2 | REF | 65% |
| 783 | s2 | REF | 65% |
| 784 | s2 | REF | 60% |
| 785 | s2 | REF | 60% |
| 786 | s2 | SNP | 60% |
| 787 | s2 | REF | 65% |
| 788 | s2 | SNP | 60% |
| 789 | s2 | SNP | 55% |
| 790 | s2 | REF | 60% |
| 791 | s2 | REF | 60% |
| 792 | s2 | SNP | 55% |
| 793 | s2 | REF | 60% |
| 794 | s2 | SNP | 55% |
| 795 | s3 | SNP | 45% |
| 796 | s3 | SNP | 50% |
| 797 | s3 | SNP | 30% |
| 798 | s3 | SNP | 50% |
| 799 | s3 | SNP | 35% |
| 800 | s3 | SNP | 45% |
| 801 | s3 | SNP | 30% |
| 802 | s3 | SNP | 55% |
| 803 | s3 | SNP | 40% |
| 804 | s3 | SNP | 35% |
| 805 | s3 | SNP | 40% |
| 806 | s4 | SNP | 55% |
| 807 | s4 | SNP | 30% |
| 808 | s4 | SNP | 55% |
| 809 | s4 | SNP | 60% |
| 810 | s4 | SNP | 35% |
| 811 | s4 | SNP | 60% |
| 812 | s4 | SNP | 40% |
| 813 | s4 | SNP | 60% |
| 814 | s4 | SNP | 35% |
| 815 | s4 | SNP | 35% |
| 816 | s4 | SNP | 35% |
| 817 | s4 | SNP | 45% |
| 818 | s4 | SNP | 55% |
| 819 | s4 | SNP | 35% |
| 820 | s4 | SNP | 50% |
| 821 | s4 | SNP | 30% |
| 822 | s4 | SNP | 50% |
| 823 | s4 | SNP | 55% |
| 824 | s4 | SNP | 40% |
| 825 | s4 | SNP | 60% |
| 826 | s4 | SNP | 60% |
| 827 | s4 | SNP | 30% |
| 828 | s4 | SNP | 65% |
| 829 | s4 | SNP | 35% |
| 830 | s4 | SNP | 50% |
| 831 | s4 | SNP | 30% |
| 832 | s4 | SNP | 45% |
| 833 | s4 | SNP | 30% |
| 834 | s4 | SNP | 50% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 835 | s4 | SNP | 60% |
| 836 | s4 | SNP | 50% |
| 837 | s4 | SNP | 45% |
| 838 | s5 | SNP | 40% |
| 839 | s5 | REF | 45% |
| 840 | s5 | SNP | 30% |
| 841 | s5 | REF | 35% |
| 842 | s5 | SNP | 55% |
| 843 | s5 | REF | 60% |
| 844 | s5 | SNP | 40% |
| 845 | s5 | REF | 45% |
| 846 | s5 | REF | 40% |
| 847 | s5 | SNP | 35% |
| 848 | s5 | REF | 40% |
| 849 | s5 | REF | 60% |
| 850 | s5 | SNP | 55% |
| 851 | s5 | SNP | 55% |
| 852 | s5 | SNP | 35% |
| 853 | s5 | REF | 40% |
| 854 | s5 | REF | 60% |
| 855 | s5 | SNP | 55% |
| 856 | s5 | REF | 60% |
| 857 | s5 | REF | 40% |
| 858 | s5 | SNP | 35% |
| 859 | s5 | SNP | 55% |
| 860 | s5 | SNP | 35% |
| 861 | s5 | SNP | 45% |
| 862 | s5 | REF | 50% |
| 863 | s5 | REF | 40% |
| 864 | s5 | SNP | 35% |
| 865 | s5 | REF | 45% |
| 866 | s5 | SNP | 40% |
| 867 | s5 | REF | 40% |
| 868 | s5 | SNP | 40% |
| 869 | s5 | REF | 45% |
| 870 | s6 | REF | 80% |
| 871 | s6 | REF | 80% |
| 872 | s6 | SNP | 75% |
| 873 | s6 | REF | 80% |
| 874 | s6 | REF | 80% |
| 875 | s6 | REF | 80% |
| 876 | s6 | SNP | 75% |
| 877 | s6 | SNP | 75% |
| 878 | s6 | SNP | 75% |
| 879 | s6 | REF | 80% |
| 880 | s6 | SNP | 80% |
| 881 | s6 | REF | 80% |
| 882 | s6 | REF | 80% |
| 883 | s6 | SNP | 75% |
| 884 | s6 | SNP | 80% |
| 885 | s6 | SNP | 80% |
| 886 | s6 | REF | 80% |
| 887 | s6 | REF | 80% |
| 888 | s6 | SNP | 75% |
| 889 | s6 | SNP | 75% |
| 890 | s6 | REF | 80% |
| 891 | s6 | SNP | 75% |
| 892 | s5 | SNP | 55% |
| 893 | s5 | REF | 60% |
| 894 | s5 | REF | 40% |
| 895 | s5 | SNP | 35% |
| 896 | s5 | REF | 40% |
| 897 | s5 | REF | 60% |
| 898 | s5 | SNP | 55% |
| 899 | s5 | REF | 65% |
| 900 | s5 | SNP | 60% |
| 901 | s5 | SNP | 55% |
| 902 | s5 | REF | 45% |
| 903 | s5 | SNP | 40% |
| 904 | s5 | SNP | 35% |
| 905 | s5 | REF | 40% |
| 906 | s5 | SNP | 60% |
| 907 | s5 | REF | 65% |
| 908 | s5 | REF | 60% |
| 909 | s5 | SNP | 55% |
| 910 | s5 | REF | 60% |
| 911 | s5 | REF | 55% |
| 912 | s5 | SNP | 50% |
| 913 | s5 | REF | 60% |
| 914 | s5 | REF | 40% |
| 915 | s5 | SNP | 35% |
| 916 | s5 | REF | 50% |
| 917 | s5 | SNP | 45% |
| 918 | s5 | REF | 60% |
| 919 | s5 | SNP | 55% |
| 920 | s5 | SNP | 55% |
| 921 | s5 | REF | 60% |
| 922 | s5 | SNP | 35% |
| 923 | s5 | REF | 35% |
| 924 | s5 | REF | 60% |
| 925 | s5 | SNP | 55% |
| 926 | s5 | REF | 45% |
| 927 | s5 | SNP | 40% |
| 928 | s5 | SNP | 50% |
| 929 | s5 | REF | 55% |
| 930 | s5 | REF | 60% |
| 931 | s5 | SNP | 55% |
| 932 | s7 | SNP | 60% |
| 933 | s7 | REF | 65% |
| 934 | s7 | SNP | 65% |
| 935 | s7 | REF | 70% |
| 936 | s7 | REF | 70% |
| 937 | s7 | SNP | 65% |
| 938 | s7 | SNP | 65% |
| 939 | s7 | REF | 70% |
| 940 | s7 | REF | 65% |
| 941 | s7 | SNP | 60% |
| 942 | s7 | SNP | 65% |
| 943 | s7 | REF | 70% |
| 944 | s7 | REF | 65% |
| 945 | s7 | SNP | 65% |
| 946 | s7 | REF | 70% |
| 947 | s7 | REF | 65% |
| 948 | s7 | SNP | 65% |
| 949 | s7 | SNP | 65% |
| 950 | s7 | REF | 70% |
| 951 | s7 | SNP | 65% |
| 952 | s7 | REF | 70% |
| 953 | s7 | REF | 75% |
| 954 | s7 | SNP | 70% |
| 955 | s7 | REF | 70% |
| 956 | s7 | SNP | 65% |
| 957 | s7 | REF | 75% |
| 958 | s7 | SNP | 70% |
| 959 | s7 | REF | 70% |
| 960 | s7 | SNP | 70% |
| 961 | s7 | REF | 75% |
| 962 | s7 | REF | 70% |
| 963 | s7 | SNP | 65% |
| 964 | s7 | SNP | 65% |
| 965 | s7 | REF | 70% |
| 966 | s7 | REF | 75% |
| 967 | s7 | SNP | 70% |
| 968 | s7 | REF | 70% |
| 969 | s7 | REF | 70% |
| 970 | s7 | SNP | 70% |
| 971 | s7 | REF | 75% |
| 972 | s7 | SNP | 65% |
| 973 | s7 | SNP | 65% |
| 974 | s7 | REF | 70% |
| 975 | s7 | REF | 70% |
| 976 | s7 | SNP | 65% |
| 977 | s7 | REF | 70% |
| 978 | s7 | REF | 70% |
| 979 | s7 | SNP | 65% |
| 980 | s7 | SNP | 65% |
| 981 | s8 | SNP | 65% |
| 982 | s8 | REF | 65% |
| 983 | s8 | REF | 65% |
| 984 | s8 | SNP | 65% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 985 | s8 | REF | 55% |
| 986 | s8 | SNP | 55% |
| 987 | s8 | SNP | 70% |
| 988 | s8 | REF | 70% |
| 989 | s8 | REF | 70% |
| 990 | s8 | SNP | 70% |
| 991 | s8 | REF | 70% |
| 992 | s8 | SNP | 70% |
| 993 | s8 | REF | 55% |
| 994 | s8 | SNP | 55% |
| 995 | s8 | REF | 55% |
| 996 | s8 | SNP | 55% |
| 997 | s8 | REF | 70% |
| 998 | s8 | SNP | 70% |
| 999 | s8 | REF | 65% |
| 1000 | s8 | SNP | 50% |
| 1001 | s8 | SNP | 70% |
| 1002 | s8 | REF | 70% |
| 1003 | s8 | REF | 50% |
| 1004 | s8 | SNP | 50% |
| 1005 | s8 | SNP | 55% |
| 1006 | s8 | REF | 55% |
| 1007 | s8 | SNP | 65% |
| 1008 | s8 | REF | 70% |
| 1009 | s8 | SNP | 70% |
| 1010 | s8 | REF | 70% |
| 1011 | s8 | SNP | 50% |
| 1012 | s8 | REF | 50% |
| 1013 | s8 | SNP | 60% |
| 1014 | s8 | REF | 60% |
| 1015 | s8 | SNP | 50% |
| 1016 | s8 | REF | 50% |
| 1017 | s8 | SNP | 70% |
| 1018 | s8 | REF | 70% |
| 1019 | s8 | SNP | 70% |
| 1020 | s8 | REF | 50% |
| 1021 | s8 | SNP | 65% |
| 1022 | s8 | REF | 65% |
| 1023 | s8 | SNP | 70% |
| 1024 | s8 | REF | 70% |
| 1025 | s8 | REF | 50% |
| 1026 | s8 | SNP | 50% |
| 1027 | s8 | SNP | 70% |
| 1028 | s8 | REF | 70% |
| 1029 | s8 | REF | 50% |
| 1030 | s8 | SNP | 50% |
| 1031 | s8 | REF | 50% |
| 1032 | s8 | SNP | 70% |
| 1033 | s8 | REF | 70% |
| 1034 | s8 | REF | 60% |
| 1035 | s8 | SNP | 60% |
| 1036 | s8 | REF | 50% |
| 1037 | s8 | SNP | 50% |
| 1038 | s8 | REF | 45% |
| 1039 | s8 | SNP | 45% |
| 1040 | s8 | REF | 45% |
| 1041 | s8 | SNP | 45% |
| 1042 | s8 | SNP | 45% |
| 1043 | s8 | REF | 45% |
| 1044 | s8 | SNP | 55% |
| 1045 | s8 | REF | 55% |
| 1046 | s8 | SNP | 70% |
| 1047 | s8 | REF | 70% |
| 1048 | s8 | SNP | 50% |
| 1049 | s8 | REF | 50% |
| 1050 | s9 | SNP | 35% |
| 1051 | s9 | REF | 40% |
| 1052 | s9 | SNP | 40% |
| 1053 | s9 | REF | 45% |
| 1054 | s9 | REF | 45% |
| 1055 | s9 | SNP | 40% |
| 1056 | s9 | SNP | 40% |
| 1057 | s9 | REF | 45% |
| 1058 | s9 | REF | 45% |
| 1059 | s9 | SNP | 40% |
| 1060 | s9 | REF | 40% |
| 1061 | s9 | REF | 45% |
| 1062 | s9 | REF | 40% |
| 1063 | s9 | SNP | 35% |
| 1064 | s9 | REF | 50% |
| 1065 | s9 | SNP | 45% |
| 1066 | s9 | SNP | 45% |
| 1067 | s9 | REF | 50% |
| 1068 | s9 | REF | 50% |
| 1069 | s9 | SNP | 45% |
| 1070 | s9 | SNP | 45% |
| 1071 | s9 | REF | 50% |
| 1072 | s9 | REF | 45% |
| 1073 | s9 | SNP | 40% |
| 1074 | s9 | REF | 45% |
| 1075 | s9 | REF | 60% |
| 1076 | s9 | SNP | 55% |
| 1077 | s9 | REF | 55% |
| 1078 | s9 | SNP | 50% |
| 1079 | s9 | REF | 55% |
| 1080 | s9 | SNP | 50% |
| 1081 | s9 | REF | 50% |
| 1082 | s9 | SNP | 45% |
| 1083 | s9 | REF | 50% |
| 1084 | s9 | SNP | 45% |
| 1085 | s9 | SNP | 35% |
| 1086 | s9 | REF | 40% |
| 1087 | s9 | REF | 45% |
| 1088 | s9 | SNP | 45% |
| 1089 | s9 | REF | 50% |
| 1090 | s9 | REF | 50% |
| 1091 | s9 | SNP | 45% |
| 1092 | s9 | SNP | 40% |
| 1093 | s9 | REF | 45% |
| 1094 | s9 | REF | 45% |
| 1095 | s9 | SNP | 40% |
| 1096 | s9 | SNP | 40% |
| 1097 | s9 | REF | 50% |
| 1098 | s9 | SNP | 45% |
| 1099 | s9 | REF | 55% |
| 1100 | s10 | REF | 60% |
| 1101 | s10 | SNP | 55% |
| 1102 | s10 | SNP | 65% |
| 1103 | s10 | REF | 70% |
| 1104 | s10 | REF | 55% |
| 1105 | s10 | SNP | 50% |
| 1106 | s10 | REF | 65% |
| 1107 | s10 | SNP | 60% |
| 1108 | s10 | SNP | 55% |
| 1109 | s10 | REF | 60% |
| 1110 | s10 | SNP | 65% |
| 1111 | s10 | REF | 70% |
| 1112 | s10 | REF | 60% |
| 1113 | s10 | SNP | 55% |
| 1114 | s10 | REF | 70% |
| 1115 | s10 | SNP | 65% |
| 1116 | s10 | SNP | 60% |
| 1117 | s10 | REF | 65% |
| 1118 | s10 | REF | 65% |
| 1119 | s10 | SNP | 65% |
| 1120 | s10 | REF | 70% |
| 1121 | s10 | SNP | 60% |
| 1122 | s10 | REF | 65% |
| 1123 | s10 | SNP | 65% |
| 1124 | s10 | REF | 70% |
| 1125 | s10 | SNP | 60% |
| 1126 | s10 | REF | 65% |
| 1127 | s10 | SNP | 55% |
| 1128 | s10 | REF | 60% |
| 1129 | s10 | REF | 60% |
| 1130 | s10 | SNP | 55% |
| 1131 | s10 | REF | 60% |
| 1132 | s10 | SNP | 55% |
| 1133 | s10 | SNP | 65% |
| 1134 | s10 | REF | 70% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 1135 | s10 | REF | 70% |
| 1136 | s10 | SNP | 65% |
| 1137 | s10 | REF | 70% |
| 1138 | s10 | SNP | 65% |
| 1139 | s10 | SNP | 65% |
| 1140 | s10 | REF | 70% |
| 1141 | s10 | REF | 70% |
| 1142 | s10 | SNP | 65% |
| 1143 | s10 | SNP | 55% |
| 1144 | s10 | REF | 60% |
| 1145 | s10 | SNP | 60% |
| 1146 | s10 | SNP | 55% |
| 1147 | s10 | REF | 60% |
| 1148 | s10 | SNP | 55% |
| 1149 | s10 | REF | 60% |
| 1150 | s10 | SNP | 60% |
| 1151 | s10 | SNP | 60% |
| 1152 | s10 | SNP | 60% |
| 1153 | s10 | REF | 65% |
| 1154 | s10 | SNP | 50% |
| 1155 | s10 | REF | 55% |
| 1156 | s10 | REF | 65% |
| 1157 | s10 | SNP | 50% |
| 1158 | s10 | REF | 55% |
| 1159 | s10 | SNP | 55% |
| 1160 | s10 | REF | 60% |
| 1161 | s11 | SNP | 60% |
| 1162 | s11 | REF | 55% |
| 1163 | s11 | SNP | 60% |
| 1164 | s11 | REF | 55% |
| 1165 | s11 | SNP | 60% |
| 1166 | s11 | REF | 55% |
| 1167 | s11 | REF | 60% |
| 1168 | s11 | SNP | 65% |
| 1169 | s11 | SNP | 70% |
| 1170 | s11 | SNP | 65% |
| 1171 | s11 | REF | 60% |
| 1172 | s11 | SNP | 65% |
| 1173 | s11 | REF | 60% |
| 1174 | s11 | REF | 65% |
| 1175 | s11 | SNP | 70% |
| 1176 | s11 | REF | 55% |
| 1177 | s11 | SNP | 60% |
| 1178 | s11 | SNP | 65% |
| 1179 | s11 | REF | 60% |
| 1180 | s11 | REF | 55% |
| 1181 | s11 | SNP | 65% |
| 1182 | s11 | SNP | 65% |
| 1183 | s11 | REF | 60% |
| 1184 | s11 | SNP | 65% |
| 1185 | s11 | REF | 60% |
| 1186 | s11 | REF | 60% |
| 1187 | s11 | SNP | 65% |
| 1188 | s11 | SNP | 65% |
| 1189 | s11 | REF | 60% |
| 1190 | s11 | REF | 60% |
| 1191 | s11 | SNP | 65% |
| 1192 | s11 | SNP | 65% |
| 1193 | s11 | REF | 60% |
| 1194 | s11 | SNP | 65% |
| 1195 | s11 | REF | 60% |
| 1196 | s11 | SNP | 65% |
| 1197 | s11 | REF | 60% |
| 1198 | s11 | SNP | 65% |
| 1199 | s11 | REF | 60% |
| 1200 | s11 | REF | 65% |
| 1201 | s11 | SNP | 70% |
| 1202 | s11 | SNP | 70% |
| 1203 | s11 | REF | 60% |
| 1204 | s11 | REF | 60% |
| 1205 | s11 | SNP | 65% |
| 1206 | s11 | REF | 65% |
| 1207 | s11 | REF | 60% |
| 1208 | s11 | SNP | 65% |
| 1209 | s11 | REF | 55% |
| 1210 | s11 | SNP | 60% |
| 1211 | s11 | SNP | 65% |
| 1212 | s11 | REF | 65% |
| 1213 | s11 | REF | 55% |
| 1214 | s11 | SNP | 60% |
| 1215 | s11 | REF | 60% |
| 1216 | s11 | SNP | 65% |
| 1217 | s11 | SNP | 70% |
| 1218 | s11 | REF | 65% |
| 1219 | s11 | SNP | 65% |
| 1220 | s11 | REF | 60% |
| 1221 | s11 | REF | 60% |
| 1222 | s11 | SNP | 65% |
| 1223 | s11 | REF | 60% |
| 1224 | s12 | SNP | 30% |
| 1225 | s12 | SNP | 35% |
| 1226 | s12 | SNP | 65% |
| 1227 | s12 | REF | 70% |
| 1228 | s12 | SNP | 40% |
| 1229 | s12 | SNP | 55% |
| 1230 | s12 | SNP | 70% |
| 1231 | s12 | SNP | 70% |
| 1232 | s12 | REF | 75% |
| 1233 | s12 | SNP | 40% |
| 1234 | s12 | SNP | 60% |
| 1235 | s12 | REF | 65% |
| 1236 | s12 | SNP | 55% |
| 1237 | s12 | SNP | 60% |
| 1238 | s12 | REF | 65% |
| 1239 | s12 | SNP | 60% |
| 1240 | s12 | SNP | 60% |
| 1241 | s12 | REF | 75% |
| 1242 | s12 | REF | 75% |
| 1243 | s12 | SNP | 70% |
| 1244 | s12 | REF | 75% |
| 1245 | s12 | SNP | 70% |
| 1246 | s12 | SNP | 30% |
| 1247 | s12 | SNP | 70% |
| 1248 | s12 | SNP | 65% |
| 1249 | s12 | REF | 75% |
| 1250 | s12 | REF | 75% |
| 1251 | s12 | SNP | 70% |
| 1252 | s12 | SNP | 35% |
| 1253 | s12 | REF | 75% |
| 1254 | s12 | SNP | 40% |
| 1255 | s12 | SNP | 50% |
| 1256 | s12 | SNP | 50% |
| 1257 | s12 | SNP | 45% |
| 1258 | s12 | SNP | 40% |
| 1259 | s12 | SNP | 40% |
| 1260 | s12 | REF | 75% |
| 1261 | s12 | SNP | 70% |
| 1262 | s12 | SNP | 45% |
| 1263 | s12 | SNP | 65% |
| 1264 | s12 | SNP | 40% |
| 1265 | s12 | SNP | 40% |
| 1266 | s12 | SNP | 40% |
| 1267 | s13 | REF | 55% |
| 1268 | s13 | REF | 60% |
| 1269 | s13 | REF | 55% |
| 1270 | s13 | REF | 50% |
| 1271 | s13 | REF | 50% |
| 1272 | s13 | REF | 45% |
| 1273 | s14 | REF | 60% |
| 1274 | s14 | SNP | 60% |
| 1275 | s14 | SNP | 65% |
| 1276 | s14 | REF | 65% |
| 1277 | s14 | REF | 60% |
| 1278 | s14 | SNP | 60% |
| 1279 | s14 | SNP | 60% |
| 1280 | s14 | REF | 60% |
| 1281 | s14 | SNP | 65% |
| 1282 | s14 | REF | 65% |
| 1283 | s14 | REF | 60% |
| 1284 | s14 | SNP | 60% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 1285 | s14 | REF | 60% |
| 1286 | s14 | SNP | 60% |
| 1287 | s14 | SNP | 55% |
| 1288 | s14 | REF | 55% |
| 1289 | s14 | SNP | 65% |
| 1290 | s14 | REF | 65% |
| 1291 | s14 | REF | 65% |
| 1292 | s14 | SNP | 65% |
| 1293 | s14 | SNP | 65% |
| 1294 | s14 | REF | 65% |
| 1295 | s14 | REF | 60% |
| 1296 | s14 | SNP | 60% |
| 1297 | s14 | REF | 55% |
| 1298 | s14 | SNP | 70% |
| 1299 | s14 | REF | 70% |
| 1300 | s14 | REF | 60% |
| 1301 | s14 | REF | 65% |
| 1302 | s14 | SNP | 65% |
| 1303 | s14 | SNP | 60% |
| 1304 | s14 | REF | 60% |
| 1305 | s14 | SNP | 60% |
| 1306 | s14 | REF | 70% |
| 1307 | s14 | SNP | 70% |
| 1308 | s14 | SNP | 60% |
| 1309 | s14 | SNP | 60% |
| 1310 | s14 | REF | 60% |
| 1311 | s14 | REF | 60% |
| 1312 | s14 | SNP | 60% |
| 1313 | s14 | SNP | 60% |
| 1314 | s14 | REF | 60% |
| 1315 | s14 | REF | 60% |
| 1316 | s14 | SNP | 60% |
| 1317 | s14 | SNP | 55% |
| 1318 | s14 | SNP | 65% |
| 1319 | s14 | REF | 65% |
| 1320 | s14 | SNP | 60% |
| 1321 | s14 | SNP | 65% |
| 1322 | s14 | REF | 65% |
| 1323 | s14 | REF | 60% |
| 1324 | s14 | REF | 60% |
| 1325 | s14 | REF | 65% |
| 1326 | s14 | SNP | 65% |
| 1327 | s14 | REF | 65% |
| 1328 | s14 | SNP | 65% |
| 1329 | s14 | REF | 65% |
| 1330 | s14 | SNP | 65% |
| 1331 | s14 | REF | 60% |
| 1332 | s14 | SNP | 60% |
| 1333 | s14 | SNP | 65% |
| 1334 | s14 | REF | 65% |
| 1335 | s14 | REF | 65% |
| 1336 | s14 | SNP | 65% |
| 1337 | s14 | REF | 65% |
| 1338 | s14 | SNP | 65% |
| 1339 | s14 | REF | 55% |
| 1340 | s14 | SNP | 55% |
| 1341 | s14 | SNP | 65% |
| 1342 | s14 | REF | 65% |
| 1343 | s14 | SNP | 60% |
| 1344 | s14 | REF | 60% |
| 1345 | s14 | REF | 65% |
| 1346 | s14 | SNP | 65% |
| 1347 | s14 | SNP | 60% |
| 1348 | s14 | REF | 60% |
| 1349 | s14 | SNP | 60% |
| 1350 | s14 | REF | 60% |
| 1351 | s14 | SNP | 55% |
| 1352 | s14 | REF | 55% |
| 1353 | s15 | REF | 30% |
| 1354 | s15 | SNP | 35% |
| 1355 | s15 | REF | 40% |
| 1356 | s15 | REF | 35% |
| 1357 | s15 | REF | 35% |
| 1358 | s15 | SNP | 30% |
| 1359 | s15 | SNP | 35% |
| 1360 | s15 | REF | 40% |
| 1361 | s15 | SNP | 35% |
| 1362 | s15 | REF | 40% |
| 1363 | s15 | REF | 30% |
| 1364 | s15 | REF | 30% |
| 1365 | s15 | REF | 40% |
| 1366 | s15 | SNP | 35% |
| 1367 | s15 | SNP | 30% |
| 1368 | s15 | REF | 35% |
| 1369 | s15 | REF | 35% |
| 1370 | s15 | REF | 30% |
| 1371 | s15 | REF | 50% |
| 1372 | s15 | REF | 30% |
| 1373 | s15 | REF | 35% |
| 1374 | s15 | SNP | 30% |
| 1375 | s15 | REF | 40% |
| 1376 | s15 | REF | 40% |
| 1377 | s15 | SNP | 35% |
| 1378 | s15 | REF | 40% |
| 1379 | s15 | SNP | 35% |
| 1380 | s15 | REF | 40% |
| 1381 | s15 | SNP | 40% |
| 1382 | s15 | REF | 45% |
| 1383 | s15 | SNP | 35% |
| 1384 | s15 | REF | 40% |
| 1385 | s15 | REF | 50% |
| 1386 | s15 | REF | 30% |
| 1387 | s15 | REF | 35% |
| 1388 | s15 | SNP | 30% |
| 1389 | s15 | SNP | 45% |
| 1390 | s15 | SNP | 30% |
| 1391 | s15 | REF | 35% |
| 1392 | s15 | REF | 45% |
| 1393 | s15 | REF | 40% |
| 1394 | s15 | SNP | 35% |
| 1395 | s15 | REF | 40% |
| 1396 | s15 | SNP | 35% |
| 1397 | s15 | SNP | 30% |
| 1398 | s15 | REF | 35% |
| 1399 | s15 | SNP | 40% |
| 1400 | s15 | REF | 40% |
| 1401 | s15 | SNP | 35% |
| 1402 | s15 | REF | 40% |
| 1403 | s15 | SNP | 35% |
| 1404 | s16 | REF | 40% |
| 1405 | s16 | SNP | 45% |
| 1406 | s16 | REF | 40% |
| 1407 | s16 | REF | 45% |
| 1408 | s16 | SNP | 50% |
| 1409 | s16 | REF | 45% |
| 1410 | s16 | SNP | 50% |
| 1411 | s16 | SNP | 50% |
| 1412 | s16 | REF | 45% |
| 1413 | s16 | REF | 45% |
| 1414 | s16 | SNP | 50% |
| 1415 | s16 | REF | 45% |
| 1416 | s16 | REF | 40% |
| 1417 | s16 | REF | 40% |
| 1418 | s16 | SNP | 45% |
| 1419 | s16 | SNP | 45% |
| 1420 | s16 | REF | 40% |
| 1421 | s16 | REF | 45% |
| 1422 | s16 | SNP | 50% |
| 1423 | s16 | REF | 45% |
| 1424 | s16 | REF | 45% |
| 1425 | s16 | SNP | 50% |
| 1426 | s16 | REF | 40% |
| 1427 | s16 | SNP | 45% |
| 1428 | s16 | REF | 45% |
| 1429 | s16 | SNP | 50% |
| 1430 | s16 | SNP | 50% |
| 1431 | s16 | REF | 45% |
| 1432 | s16 | SNP | 50% |
| 1433 | s16 | SNP | 60% |
| 1434 | s16 | SNP | 55% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 1435 | s16 | REF | 50% |
| 1436 | s16 | REF | 45% |
| 1437 | s16 | SNP | 50% |
| 1438 | s16 | SNP | 50% |
| 1439 | s16 | REF | 45% |
| 1440 | s16 | SNP | 45% |
| 1441 | s16 | SNP | 50% |
| 1442 | s16 | REF | 45% |
| 1443 | s16 | REF | 45% |
| 1444 | s16 | SNP | 50% |
| 1445 | s16 | REF | 50% |
| 1446 | s16 | SNP | 55% |
| 1447 | s16 | REF | 50% |
| 1448 | s16 | SNP | 55% |
| 1449 | s16 | REF | 55% |
| 1450 | s16 | SNP | 60% |
| 1451 | s16 | SNP | 50% |
| 1452 | s16 | REF | 45% |
| 1453 | s16 | SNP | 50% |
| 1454 | s16 | REF | 45% |
| 1455 | s16 | SNP | 45% |
| 1456 | s16 | REF | 40% |
| 1457 | s16 | REF | 40% |
| 1458 | s16 | SNP | 45% |
| 1459 | s16 | SNP | 45% |
| 1460 | s16 | REF | 40% |
| 1461 | s16 | SNP | 45% |
| 1462 | s16 | REF | 40% |
| 1463 | s16 | SNP | 45% |
| 1464 | s16 | REF | 40% |
| 1465 | s16 | REF | 40% |
| 1466 | s16 | REF | 40% |
| 1467 | s16 | SNP | 45% |
| 1468 | s16 | SNP | 45% |
| 1469 | s16 | SNP | 55% |
| 1470 | s16 | SNP | 50% |
| 1471 | s16 | REF | 45% |
| 1472 | s16 | SNP | 45% |
| 1473 | s16 | REF | 40% |
| 1474 | s16 | REF | 55% |
| 1475 | s16 | SNP | 45% |
| 1476 | s16 | REF | 40% |
| 1477 | s16 | SNP | 50% |
| 1478 | s16 | REF | 45% |
| 1479 | s16 | REF | 40% |
| 1480 | s16 | SNP | 45% |
| 1481 | s16 | SNP | 50% |
| 1482 | s16 | REF | 50% |
| 1483 | s16 | REF | 45% |
| 1484 | s17 | SNP | 45% |
| 1485 | s17 | REF | 40% |
| 1486 | s17 | REF | 45% |
| 1487 | s17 | REF | 30% |
| 1488 | s17 | SNP | 35% |
| 1489 | s17 | SNP | 50% |
| 1490 | s17 | REF | 35% |
| 1491 | s17 | SNP | 55% |
| 1492 | s17 | REF | 40% |
| 1493 | s17 | REF | 45% |
| 1494 | s17 | SNP | 50% |
| 1495 | s17 | REF | 45% |
| 1496 | s17 | SNP | 40% |
| 1497 | s17 | REF | 35% |
| 1498 | s17 | REF | 45% |
| 1499 | s17 | SNP | 50% |
| 1500 | s17 | REF | 50% |
| 1501 | s17 | SNP | 55% |
| 1502 | s17 | SNP | 45% |
| 1503 | s17 | REF | 40% |
| 1504 | s17 | SNP | 50% |
| 1505 | s17 | REF | 45% |
| 1506 | s17 | REF | 35% |
| 1507 | s17 | SNP | 40% |
| 1508 | s17 | SNP | 50% |
| 1509 | s17 | REF | 45% |
| 1510 | s17 | SNP | 40% |
| 1511 | s17 | REF | 35% |
| 1512 | s17 | SNP | 50% |
| 1513 | s17 | SNP | 50% |
| 1514 | s17 | REF | 30% |
| 1515 | s17 | SNP | 35% |
| 1516 | s17 | REF | 45% |
| 1517 | s17 | SNP | 50% |
| 1518 | s17 | REF | 45% |
| 1519 | s17 | SNP | 50% |
| 1520 | s17 | SNP | 50% |
| 1521 | s17 | REF | 40% |
| 1522 | s17 | REF | 35% |
| 1523 | s17 | SNP | 45% |
| 1524 | s17 | REF | 30% |
| 1525 | s17 | REF | 35% |
| 1526 | s17 | SNP | 40% |
| 1527 | s17 | SNP | 30% |
| 1528 | s18 | REF | 40% |
| 1529 | s18 | REF | 40% |
| 1530 | s18 | SNP | 45% |
| 1531 | s18 | REF | 40% |
| 1532 | s18 | SNP | 40% |
| 1533 | s18 | SNP | 45% |
| 1534 | s18 | REF | 40% |
| 1535 | s18 | REF | 30% |
| 1536 | s18 | SNP | 35% |
| 1537 | s18 | SNP | 45% |
| 1538 | s18 | SNP | 30% |
| 1539 | s18 | SNP | 35% |
| 1540 | s18 | REF | 30% |
| 1541 | s18 | SNP | 45% |
| 1542 | s18 | REF | 40% |
| 1543 | s18 | SNP | 35% |
| 1544 | s18 | SNP | 40% |
| 1545 | s18 | REF | 35% |
| 1546 | s18 | REF | 35% |
| 1547 | s18 | SNP | 40% |
| 1548 | s18 | SNP | 35% |
| 1549 | s18 | REF | 40% |
| 1550 | s18 | SNP | 45% |
| 1551 | s18 | SNP | 45% |
| 1552 | s18 | REF | 35% |
| 1553 | s18 | SNP | 40% |
| 1554 | s18 | REF | 35% |
| 1555 | s18 | SNP | 45% |
| 1556 | s18 | REF | 40% |
| 1557 | s18 | SNP | 35% |
| 1558 | s18 | REF | 30% |
| 1559 | s18 | REF | 40% |
| 1560 | s18 | SNP | 35% |
| 1561 | s18 | SNP | 35% |
| 1562 | s18 | REF | 35% |
| 1563 | s18 | SNP | 40% |
| 1564 | s18 | SNP | 45% |
| 1565 | s18 | SNP | 40% |
| 1566 | s18 | REF | 35% |
| 1567 | s18 | REF | 30% |
| 1568 | s18 | SNP | 35% |
| 1569 | s18 | SNP | 30% |
| 1570 | s18 | REF | 30% |
| 1571 | s18 | SNP | 35% |
| 1572 | s18 | REF | 30% |
| 1573 | s18 | REF | 30% |
| 1574 | s19 | REF | 50% |
| 1575 | s19 | SNP | 55% |
| 1576 | s19 | REF | 55% |
| 1577 | s19 | SNP | 60% |
| 1578 | s19 | SNP | 60% |
| 1579 | s19 | REF | 55% |
| 1580 | s19 | SNP | 55% |
| 1581 | s19 | REF | 50% |
| 1582 | s19 | REF | 55% |
| 1583 | s19 | SNP | 60% |
| 1584 | s19 | REF | 55% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 1585 | s19 | SNP | 60% |
| 1586 | s19 | SNP | 55% |
| 1587 | s19 | REF | 50% |
| 1588 | s19 | REF | 45% |
| 1589 | s19 | SNP | 50% |
| 1590 | s19 | SNP | 50% |
| 1591 | s19 | SNP | 55% |
| 1592 | s19 | REF | 50% |
| 1593 | s19 | REF | 60% |
| 1594 | s19 | REF | 55% |
| 1595 | s19 | SNP | 60% |
| 1596 | s19 | REF | 55% |
| 1597 | s19 | SNP | 65% |
| 1598 | s19 | REF | 60% |
| 1599 | s19 | SNP | 60% |
| 1600 | s19 | REF | 55% |
| 1601 | s19 | REF | 55% |
| 1602 | s19 | SNP | 60% |
| 1603 | s19 | REF | 55% |
| 1604 | s19 | SNP | 60% |
| 1605 | s19 | SNP | 55% |
| 1606 | s19 | REF | 50% |
| 1607 | s19 | REF | 55% |
| 1608 | s19 | SNP | 60% |
| 1609 | s19 | REF | 55% |
| 1610 | s19 | SNP | 60% |
| 1611 | s19 | SNP | 60% |
| 1612 | s19 | REF | 55% |
| 1613 | s19 | SNP | 50% |
| 1614 | s19 | REF | 55% |
| 1615 | s19 | SNP | 60% |
| 1616 | s19 | SNP | 60% |
| 1617 | s19 | REF | 55% |
| 1618 | s19 | SNP | 60% |
| 1619 | s19 | REF | 55% |
| 1620 | s19 | REF | 45% |
| 1621 | s19 | SNP | 60% |
| 1622 | s19 | REF | 55% |
| 1623 | s19 | REF | 50% |
| 1624 | s19 | REF | 45% |
| 1625 | s19 | REF | 50% |
| 1626 | s19 | SNP | 55% |
| 1627 | s19 | SNP | 60% |
| 1628 | s19 | REF | 55% |
| 1629 | s19 | SNP | 55% |
| 1630 | s19 | SNP | 55% |
| 1631 | s19 | REF | 50% |
| 1632 | s19 | SNP | 55% |
| 1633 | s19 | REF | 50% |
| 1634 | s20 | SNP | 45% |
| 1635 | s20 | REF | 50% |
| 1636 | s20 | REF | 45% |
| 1637 | s20 | SNP | 40% |
| 1638 | s20 | SNP | 40% |
| 1639 | s20 | SNP | 40% |
| 1640 | s20 | REF | 45% |
| 1641 | s20 | SNP | 45% |
| 1642 | s20 | REF | 50% |
| 1643 | s20 | SNP | 40% |
| 1644 | s20 | REF | 45% |
| 1645 | s20 | REF | 50% |
| 1646 | s20 | SNP | 45% |
| 1647 | s20 | SNP | 40% |
| 1648 | s20 | REF | 45% |
| 1649 | s20 | REF | 50% |
| 1650 | s20 | REF | 45% |
| 1651 | s20 | SNP | 40% |
| 1652 | s20 | REF | 50% |
| 1653 | s20 | SNP | 45% |
| 1654 | s20 | REF | 45% |
| 1655 | s20 | SNP | 40% |
| 1656 | s20 | REF | 50% |
| 1657 | s20 | REF | 50% |
| 1658 | s20 | SNP | 45% |
| 1659 | s20 | REF | 50% |
| 1660 | s20 | REF | 50% |
| 1661 | s20 | REF | 50% |
| 1662 | s20 | SNP | 45% |
| 1663 | s20 | REF | 50% |
| 1664 | s20 | SNP | 45% |
| 1665 | s20 | SNP | 40% |
| 1666 | s20 | REF | 50% |
| 1667 | s20 | SNP | 45% |
| 1668 | s20 | REF | 45% |
| 1669 | s20 | REF | 50% |
| 1670 | s20 | SNP | 45% |
| 1671 | s20 | REF | 50% |
| 1672 | s20 | SNP | 45% |
| 1673 | s20 | REF | 50% |
| 1674 | s20 | REF | 45% |
| 1675 | s20 | REF | 50% |
| 1676 | s20 | SNP | 45% |
| 1677 | s20 | REF | 50% |
| 1678 | s20 | REF | 50% |
| 1679 | s20 | REF | 50% |
| 1680 | s20 | SNP | 45% |
| 1681 | s20 | REF | 50% |
| 1682 | s20 | SNP | 45% |
| 1683 | s20 | REF | 50% |
| 1684 | s20 | SNP | 45% |
| 1685 | s20 | REF | 50% |
| 1686 | s20 | SNP | 40% |
| 1687 | s20 | REF | 45% |
| 1688 | s20 | REF | 50% |
| 1689 | s20 | SNP | 45% |
| 1690 | s20 | SNP | 45% |
| 1691 | s20 | REF | 50% |
| 1692 | s20 | REF | 45% |
| 1693 | s20 | SNP | 40% |
| 1694 | s20 | SNP | 45% |
| 1695 | s20 | REF | 50% |
| 1696 | s20 | REF | 50% |
| 1697 | s20 | SNP | 45% |
| 1698 | s20 | REF | 45% |
| 1699 | s20 | SNP | 40% |
| 1700 | s20 | REF | 45% |
| 1701 | s20 | SNP | 40% |
| 1702 | s21 | SNP | 40% |
| 1703 | s21 | SNP | 35% |
| 1704 | s21 | REF | 35% |
| 1705 | s21 | SNP | 40% |
| 1706 | s21 | SNP | 40% |
| 1707 | s21 | SNP | 40% |
| 1708 | s21 | SNP | 40% |
| 1709 | s21 | SNP | 35% |
| 1710 | s21 | SNP | 40% |
| 1711 | s21 | REF | 35% |
| 1712 | s21 | SNP | 40% |
| 1713 | s21 | SNP | 35% |
| 1714 | s21 | SNP | 40% |
| 1715 | s21 | REF | 35% |
| 1716 | s21 | SNP | 40% |
| 1717 | s21 | REF | 35% |
| 1718 | s21 | SNP | 40% |
| 1719 | s21 | REF | 35% |
| 1720 | s21 | SNP | 40% |
| 1721 | s22 | SNP | 35% |
| 1722 | s22 | SNP | 40% |
| 1723 | s22 | SNP | 40% |
| 1724 | s22 | SNP | 45% |
| 1725 | s22 | REF | 45% |
| 1726 | s22 | SNP | 50% |
| 1727 | s22 | SNP | 40% |
| 1728 | s22 | REF | 35% |
| 1729 | s22 | SNP | 45% |
| 1730 | s22 | REF | 40% |
| 1731 | s22 | SNP | 40% |
| 1732 | s22 | SNP | 45% |
| 1733 | s22 | SNP | 50% |
| 1734 | s22 | REF | 45% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 1735 | s22 | SNP | 50% |
| 1736 | s22 | REF | 45% |
| 1737 | s22 | SNP | 50% |
| 1738 | s22 | REF | 45% |
| 1739 | s22 | SNP | 50% |
| 1740 | s22 | SNP | 40% |
| 1741 | s22 | REF | 35% |
| 1742 | s22 | REF | 45% |
| 1743 | s22 | SNP | 45% |
| 1744 | s22 | REF | 40% |
| 1745 | s23 | REF | 55% |
| 1746 | s23 | REF | 60% |
| 1747 | s23 | REF | 55% |
| 1748 | s23 | SNP | 60% |
| 1749 | s23 | SNP | 65% |
| 1750 | s23 | REF | 65% |
| 1751 | s23 | SNP | 70% |
| 1752 | s23 | REF | 60% |
| 1753 | s23 | SNP | 70% |
| 1754 | s23 | REF | 65% |
| 1755 | s23 | SNP | 60% |
| 1756 | s23 | REF | 65% |
| 1757 | s23 | SNP | 70% |
| 1758 | s23 | REF | 60% |
| 1759 | s23 | SNP | 65% |
| 1760 | s23 | SNP | 65% |
| 1761 | s23 | REF | 60% |
| 1762 | s23 | REF | 55% |
| 1763 | s23 | REF | 65% |
| 1764 | s23 | SNP | 70% |
| 1765 | s23 | SNP | 75% |
| 1766 | s23 | REF | 70% |
| 1767 | s23 | SNP | 70% |
| 1768 | s23 | REF | 65% |
| 1769 | s23 | SNP | 70% |
| 1770 | s23 | REF | 65% |
| 1771 | s23 | SNP | 70% |
| 1772 | s23 | REF | 65% |
| 1773 | s23 | SNP | 70% |
| 1774 | s23 | REF | 65% |
| 1775 | s23 | SNP | 65% |
| 1776 | s23 | REF | 65% |
| 1777 | s23 | SNP | 70% |
| 1778 | s23 | REF | 65% |
| 1779 | s23 | REF | 65% |
| 1780 | s23 | SNP | 70% |
| 1781 | s23 | REF | 60% |
| 1782 | s23 | REF | 60% |
| 1783 | s23 | SNP | 65% |
| 1784 | s23 | REF | 60% |
| 1785 | s23 | REF | 65% |
| 1786 | s23 | SNP | 70% |
| 1787 | s23 | SNP | 60% |
| 1788 | s23 | REF | 65% |
| 1789 | s23 | SNP | 70% |
| 1790 | s23 | REF | 65% |
| 1791 | s23 | REF | 60% |
| 1792 | s23 | REF | 60% |
| 1793 | s23 | REF | 60% |
| 1794 | s23 | SNP | 65% |
| 1795 | s23 | SNP | 70% |
| 1796 | s23 | REF | 65% |
| 1797 | s23 | SNP | 65% |
| 1798 | s23 | REF | 60% |
| 1799 | s23 | SNP | 65% |
| 1800 | s23 | REF | 55% |
| 1801 | s23 | REF | 60% |
| 1802 | s23 | SNP | 65% |
| 1803 | s24 | REF | 65% |
| 1804 | s24 | REF | 60% |
| 1805 | s24 | SNP | 60% |
| 1806 | s24 | REF | 65% |
| 1807 | s24 | SNP | 65% |
| 1808 | s24 | REF | 60% |
| 1809 | s24 | REF | 55% |
| 1810 | s24 | SNP | 55% |
| 1811 | s24 | REF | 65% |
| 1812 | s24 | REF | 65% |
| 1813 | s24 | SNP | 55% |
| 1814 | s24 | REF | 55% |
| 1815 | s24 | REF | 60% |
| 1816 | s24 | SNP | 60% |
| 1817 | s24 | SNP | 60% |
| 1818 | s24 | REF | 60% |
| 1819 | s24 | REF | 60% |
| 1820 | s24 | SNP | 60% |
| 1821 | s24 | REF | 70% |
| 1822 | s25 | SNP | 80% |
| 1823 | s25 | REF | 75% |
| 1824 | s25 | SNP | 75% |
| 1825 | s25 | REF | 70% |
| 1826 | s25 | REF | 70% |
| 1827 | s25 | SNP | 75% |
| 1828 | s25 | REF | 75% |
| 1829 | s25 | REF | 75% |
| 1830 | s25 | SNP | 80% |
| 1831 | s25 | SNP | 80% |
| 1832 | s25 | REF | 75% |
| 1833 | s25 | SNP | 80% |
| 1834 | s25 | REF | 80% |
| 1835 | s25 | SNP | 80% |
| 1836 | s25 | REF | 75% |
| 1837 | s25 | REF | 80% |
| 1838 | s25 | SNP | 80% |
| 1839 | s25 | REF | 75% |
| 1840 | s25 | SNP | 80% |
| 1841 | s25 | REF | 75% |
| 1842 | s25 | SNP | 80% |
| 1843 | s25 | REF | 75% |
| 1844 | s25 | REF | 75% |
| 1845 | s25 | SNP | 80% |
| 1846 | s25 | SNP | 80% |
| 1847 | s25 | REF | 75% |
| 1848 | s25 | SNP | 80% |
| 1849 | s25 | REF | 75% |
| 1850 | s25 | REF | 75% |
| 1851 | s25 | SNP | 80% |
| 1852 | s25 | REF | 75% |
| 1853 | s25 | SNP | 80% |
| 1854 | s25 | REF | 80% |
| 1855 | s25 | SNP | 80% |
| 1856 | s25 | REF | 75% |
| 1857 | s25 | SNP | 80% |
| 1858 | s25 | REF | 75% |
| 1859 | s25 | SNP | 80% |
| 1860 | s25 | REF | 80% |
| 1861 | s25 | SNP | 80% |
| 1862 | s25 | REF | 75% |
| 1863 | s25 | REF | 75% |
| 1864 | s25 | SNP | 80% |
| 1865 | s25 | SNP | 75% |
| 1866 | s25 | REF | 70% |
| 1867 | s25 | SNP | 80% |
| 1868 | s25 | REF | 75% |
| 1869 | s25 | REF | 70% |
| 1870 | s25 | SNP | 75% |
| 1871 | s25 | REF | 75% |
| 1872 | s25 | REF | 75% |
| 1873 | s25 | SNP | 80% |
| 1874 | s24 | SNP | 70% |
| 1875 | s24 | REF | 70% |
| 1876 | s24 | SNP | 65% |
| 1877 | s24 | REF | 55% |
| 1878 | s24 | SNP | 55% |
| 1879 | s24 | SNP | 55% |
| 1880 | s24 | REF | 55% |
| 1881 | s24 | SNP | 70% |
| 1882 | s24 | REF | 70% |
| 1883 | s24 | REF | 65% |
| 1884 | s24 | SNP | 70% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 1885 | s24 | SNP | 60% |
| 1886 | s24 | SNP | 60% |
| 1887 | s24 | REF | 60% |
| 1888 | s24 | SNP | 65% |
| 1889 | s24 | REF | 65% |
| 1890 | s24 | SNP | 65% |
| 1891 | s24 | REF | 65% |
| 1892 | s24 | SNP | 55% |
| 1893 | s24 | REF | 55% |
| 1894 | s26 | SNP | 45% |
| 1895 | s26 | SNP | 50% |
| 1896 | s26 | SNP | 40% |
| 1897 | s26 | SNP | 40% |
| 1898 | s26 | REF | 45% |
| 1899 | s26 | SNP | 40% |
| 1900 | s26 | SNP | 50% |
| 1901 | s26 | SNP | 50% |
| 1902 | s26 | SNP | 45% |
| 1903 | s26 | SNP | 55% |
| 1904 | s26 | SNP | 50% |
| 1905 | s26 | SNP | 40% |
| 1906 | s26 | SNP | 50% |
| 1907 | s26 | SNP | 50% |
| 1908 | s26 | SNP | 55% |
| 1909 | s26 | REF | 45% |
| 1910 | s26 | SNP | 45% |
| 1911 | s26 | SNP | 40% |
| 1912 | s26 | SNP | 50% |
| 1913 | s26 | SNP | 45% |
| 1914 | s26 | SNP | 55% |
| 1915 | s26 | SNP | 45% |
| 1916 | s26 | SNP | 50% |
| 1917 | s26 | SNP | 50% |
| 1918 | s26 | SNP | 55% |
| 1919 | s26 | SNP | 45% |
| 1920 | s26 | SNP | 45% |
| 1921 | s26 | SNP | 40% |
| 1922 | s26 | SNP | 45% |
| 1923 | s26 | SNP | 55% |
| 1924 | s26 | SNP | 45% |
| 1925 | s26 | SNP | 50% |
| 1926 | s26 | SNP | 50% |
| 1927 | s27 | REF | 60% |
| 1928 | s27 | REF | 60% |
| 1929 | s27 | REF | 65% |
| 1930 | s27 | REF | 60% |
| 1931 | s27 | REF | 55% |
| 1932 | s27 | SNP | 55% |
| 1933 | s27 | REF | 50% |
| 1934 | s27 | REF | 65% |
| 1935 | s27 | SNP | 50% |
| 1936 | s27 | REF | 65% |
| 1937 | s27 | REF | 65% |
| 1938 | s27 | REF | 65% |
| 1939 | s27 | SNP | 60% |
| 1940 | s27 | REF | 65% |
| 1941 | s27 | SNP | 60% |
| 1942 | s27 | REF | 65% |
| 1943 | s27 | SNP | 45% |
| 1944 | s27 | REF | 60% |
| 1945 | s27 | REF | 65% |
| 1946 | s27 | REF | 55% |
| 1947 | s27 | SNP | 45% |
| 1948 | s27 | REF | 50% |
| 1949 | s28 | REF | 55% |
| 1950 | s28 | SNP | 50% |
| 1951 | s28 | REF | 65% |
| 1952 | s28 | SNP | 60% |
| 1953 | s28 | SNP | 65% |
| 1954 | s28 | REF | 70% |
| 1955 | s28 | SNP | 65% |
| 1956 | s28 | REF | 70% |
| 1957 | s28 | SNP | 45% |
| 1958 | s28 | REF | 50% |
| 1959 | s28 | SNP | 45% |
| 1960 | s28 | REF | 50% |
| 1961 | s28 | SNP | 45% |
| 1962 | s28 | REF | 45% |
| 1963 | s28 | SNP | 40% |
| 1964 | s28 | REF | 50% |
| 1965 | s28 | REF | 45% |
| 1966 | s28 | SNP | 40% |
| 1967 | s28 | SNP | 65% |
| 1968 | s28 | REF | 70% |
| 1969 | s28 | SNP | 50% |
| 1970 | s28 | REF | 55% |
| 1971 | s28 | SNP | 70% |
| 1972 | s28 | REF | 75% |
| 1973 | s28 | SNP | 50% |
| 1974 | s28 | REF | 55% |
| 1975 | s28 | SNP | 55% |
| 1976 | s28 | REF | 60% |
| 1977 | s28 | SNP | 65% |
| 1978 | s28 | REF | 70% |
| 1979 | s28 | SNP | 40% |
| 1980 | s28 | REF | 45% |
| 1981 | s28 | REF | 50% |
| 1982 | s28 | SNP | 45% |
| 1983 | s28 | SNP | 50% |
| 1984 | s28 | REF | 45% |
| 1985 | s28 | SNP | 40% |
| 1986 | s28 | SNP | 45% |
| 1987 | s28 | REF | 50% |
| 1988 | s28 | REF | 55% |
| 1989 | s28 | SNP | 50% |
| 1990 | s28 | SNP | 50% |
| 1991 | s28 | REF | 50% |
| 1992 | s28 | SNP | 45% |
| 1993 | s28 | REF | 55% |
| 1994 | s28 | SNP | 50% |
| 1995 | s28 | REF | 50% |
| 1996 | s28 | SNP | 45% |
| 1997 | s28 | REF | 55% |
| 1998 | s28 | REF | 55% |
| 1999 | s28 | SNP | 45% |
| 2000 | s28 | REF | 50% |
| 2001 | s28 | REF | 50% |
| 2002 | s28 | SNP | 45% |
| 2003 | s28 | REF | 50% |
| 2004 | s28 | SNP | 40% |
| 2005 | s28 | REF | 45% |
| 2006 | s28 | SNP | 40% |
| 2007 | s28 | REF | 45% |
| 2008 | s29 | REF | 65% |
| 2009 | s29 | SNP | 60% |
| 2010 | s29 | SNP | 50% |
| 2011 | s29 | REF | 55% |
| 2012 | s29 | SNP | 50% |
| 2013 | s29 | SNP | 50% |
| 2014 | s29 | REF | 55% |
| 2015 | s29 | REF | 70% |
| 2016 | s29 | SNP | 65% |
| 2017 | s29 | REF | 55% |
| 2018 | s29 | SNP | 55% |
| 2019 | s29 | REF | 70% |
| 2020 | s29 | SNP | 65% |
| 2021 | s29 | SNP | 55% |
| 2022 | s29 | SNP | 50% |
| 2023 | s29 | REF | 55% |
| 2024 | s29 | REF | 55% |
| 2025 | s29 | SNP | 50% |
| 2026 | s29 | REF | 60% |
| 2027 | s29 | REF | 70% |
| 2028 | s29 | SNP | 65% |
| 2029 | s29 | SNP | 50% |
| 2030 | s29 | REF | 55% |
| 2031 | s29 | SNP | 50% |
| 2032 | s29 | REF | 55% |
| 2033 | s29 | SNP | 65% |
| 2034 | s29 | REF | 70% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 2035 | s29 | SNP | 65% |
| 2036 | s29 | REF | 70% |
| 2037 | s29 | REF | 70% |
| 2038 | s29 | SNP | 60% |
| 2039 | s29 | REF | 65% |
| 2040 | s29 | SNP | 50% |
| 2041 | s29 | REF | 55% |
| 2042 | s29 | REF | 70% |
| 2043 | s29 | SNP | 65% |
| 2044 | s29 | REF | 55% |
| 2045 | s29 | SNP | 50% |
| 2046 | s29 | SNP | 50% |
| 2047 | s29 | REF | 55% |
| 2048 | s29 | REF | 55% |
| 2049 | s29 | SNP | 50% |
| 2050 | s29 | REF | 60% |
| 2051 | s29 | SNP | 60% |
| 2052 | s29 | REF | 65% |
| 2053 | s29 | SNP | 55% |
| 2054 | s29 | REF | 60% |
| 2055 | s29 | SNP | 50% |
| 2056 | s29 | REF | 55% |
| 2057 | s29 | SNP | 65% |
| 2058 | s29 | REF | 70% |
| 2059 | s29 | SNP | 65% |
| 2060 | s30 | REF | 50% |
| 2061 | s30 | REF | 55% |
| 2062 | s30 | SNP | 50% |
| 2063 | s30 | REF | 60% |
| 2064 | s30 | SNP | 55% |
| 2065 | s30 | REF | 70% |
| 2066 | s30 | SNP | 55% |
| 2067 | s30 | REF | 60% |
| 2068 | s30 | REF | 60% |
| 2069 | s30 | REF | 75% |
| 2070 | s30 | SNP | 60% |
| 2071 | s30 | REF | 65% |
| 2072 | s30 | REF | 70% |
| 2073 | s30 | SNP | 55% |
| 2074 | s30 | REF | 75% |
| 2075 | s30 | REF | 60% |
| 2076 | s30 | REF | 60% |
| 2077 | s30 | REF | 70% |
| 2078 | s30 | SNP | 65% |
| 2079 | s30 | REF | 70% |
| 2080 | s30 | SNP | 70% |
| 2081 | s30 | REF | 75% |
| 2082 | s30 | REF | 55% |
| 2083 | s30 | REF | 70% |
| 2084 | s30 | SNP | 65% |
| 2085 | s30 | SNP | 55% |
| 2086 | s30 | REF | 65% |
| 2087 | s30 | SNP | 60% |
| 2088 | s30 | SNP | 65% |
| 2089 | s30 | REF | 70% |
| 2090 | s30 | REF | 70% |
| 2091 | s30 | SNP | 60% |
| 2092 | s30 | REF | 60% |
| 2093 | s30 | REF | 65% |
| 2094 | s30 | REF | 70% |
| 2095 | s30 | SNP | 65% |
| 2096 | s30 | SNP | 55% |
| 2097 | s30 | SNP | 55% |
| 2098 | s30 | REF | 60% |
| 2099 | s30 | SNP | 65% |
| 2100 | s30 | REF | 70% |
| 2101 | s30 | REF | 65% |
| 2102 | s30 | SNP | 60% |
| 2103 | s30 | SNP | 70% |
| 2104 | s30 | REF | 75% |
| 2105 | s30 | REF | 65% |
| 2106 | s30 | REF | 65% |
| 2107 | s30 | SNP | 60% |
| 2108 | s30 | REF | 60% |
| 2109 | s30 | SNP | 55% |
| 2110 | s30 | SNP | 60% |
| 2111 | s30 | REF | 65% |
| 2112 | s31 | SNP | 40% |
| 2113 | s31 | REF | 45% |
| 2114 | s31 | SNP | 45% |
| 2115 | s31 | SNP | 30% |
| 2116 | s31 | SNP | 35% |
| 2117 | s31 | REF | 50% |
| 2118 | s31 | SNP | 40% |
| 2119 | s31 | SNP | 30% |
| 2120 | s31 | SNP | 35% |
| 2121 | s31 | SNP | 35% |
| 2122 | s31 | SNP | 35% |
| 2123 | s31 | SNP | 35% |
| 2124 | s31 | REF | 50% |
| 2125 | s31 | REF | 45% |
| 2126 | s31 | SNP | 40% |
| 2127 | s31 | SNP | 35% |
| 2128 | s31 | SNP | 40% |
| 2129 | s31 | REF | 45% |
| 2130 | s31 | REF | 50% |
| 2131 | s31 | SNP | 45% |
| 2132 | s31 | SNP | 45% |
| 2133 | s31 | REF | 50% |
| 2134 | s31 | SNP | 40% |
| 2135 | s31 | SNP | 30% |
| 2136 | s31 | REF | 45% |
| 2137 | s31 | SNP | 40% |
| 2138 | s31 | SNP | 35% |
| 2139 | s31 | SNP | 35% |
| 2140 | s31 | SNP | 35% |
| 2141 | s31 | SNP | 40% |
| 2142 | s31 | REF | 45% |
| 2143 | s31 | REF | 50% |
| 2144 | s31 | SNP | 45% |
| 2145 | s31 | SNP | 40% |
| 2146 | s31 | REF | 45% |
| 2147 | s31 | SNP | 35% |
| 2148 | s31 | SNP | 35% |
| 2149 | s32 | SNP | 60% |
| 2150 | s32 | REF | 65% |
| 2151 | s32 | REF | 55% |
| 2152 | s32 | SNP | 60% |
| 2153 | s32 | REF | 65% |
| 2154 | s32 | SNP | 50% |
| 2155 | s32 | REF | 55% |
| 2156 | s32 | SNP | 65% |
| 2157 | s32 | REF | 70% |
| 2158 | s32 | SNP | 50% |
| 2159 | s32 | SNP | 60% |
| 2160 | s32 | SNP | 60% |
| 2161 | s32 | REF | 65% |
| 2162 | s32 | REF | 55% |
| 2163 | s32 | SNP | 65% |
| 2164 | s32 | REF | 70% |
| 2165 | s32 | SNP | 50% |
| 2166 | s32 | REF | 55% |
| 2167 | s32 | SNP | 50% |
| 2168 | s32 | REF | 55% |
| 2169 | s32 | SNP | 50% |
| 2170 | s32 | REF | 60% |
| 2171 | s32 | SNP | 55% |
| 2172 | s32 | REF | 60% |
| 2173 | s32 | REF | 65% |
| 2174 | s32 | SNP | 60% |
| 2175 | s32 | REF | 65% |
| 2176 | s32 | SNP | 60% |
| 2177 | s32 | SNP | 65% |
| 2178 | s32 | REF | 70% |
| 2179 | s32 | REF | 70% |
| 2180 | s32 | SNP | 65% |
| 2181 | s32 | SNP | 65% |
| 2182 | s32 | REF | 60% |
| 2183 | s32 | SNP | 55% |
| 2184 | s32 | SNP | 55% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 2185 | s32 | REF | 60% |
| 2186 | s32 | REF | 75% |
| 2187 | s32 | SNP | 70% |
| 2188 | s32 | SNP | 70% |
| 2189 | s32 | REF | 60% |
| 2190 | s32 | SNP | 55% |
| 2191 | s32 | REF | 75% |
| 2192 | s32 | REF | 70% |
| 2193 | s32 | REF | 70% |
| 2194 | s32 | SNP | 65% |
| 2195 | s32 | REF | 65% |
| 2196 | s32 | SNP | 60% |
| 2197 | s32 | REF | 65% |
| 2198 | s32 | SNP | 55% |
| 2199 | s32 | REF | 60% |
| 2200 | s32 | SNP | 60% |
| 2201 | s32 | REF | 65% |
| 2202 | s32 | SNP | 55% |
| 2203 | s32 | REF | 70% |
| 2204 | s32 | SNP | 65% |
| 2205 | s32 | REF | 60% |
| 2206 | s32 | SNP | 55% |
| 2207 | s32 | REF | 65% |
| 2208 | s32 | SNP | 60% |
| 2209 | s32 | REF | 65% |
| 2210 | s32 | SNP | 60% |
| 2211 | s33 | SNP | 65% |
| 2212 | s33 | SNP | 65% |
| 2213 | s33 | REF | 70% |
| 2214 | s33 | SNP | 65% |
| 2215 | s33 | REF | 70% |
| 2216 | s33 | REF | 70% |
| 2217 | s33 | SNP | 65% |
| 2218 | s33 | REF | 70% |
| 2219 | s33 | REF | 70% |
| 2220 | s33 | SNP | 70% |
| 2221 | s33 | REF | 75% |
| 2222 | s33 | SNP | 70% |
| 2223 | s33 | REF | 75% |
| 2224 | s33 | SNP | 70% |
| 2225 | s33 | REF | 75% |
| 2226 | s33 | SNP | 70% |
| 2227 | s33 | REF | 75% |
| 2228 | s33 | REF | 70% |
| 2229 | s33 | REF | 70% |
| 2230 | s33 | SNP | 65% |
| 2231 | s33 | REF | 70% |
| 2232 | s33 | REF | 70% |
| 2233 | s33 | SNP | 65% |
| 2234 | s33 | REF | 75% |
| 2235 | s33 | REF | 70% |
| 2236 | s33 | REF | 70% |
| 2237 | s33 | REF | 75% |
| 2238 | s33 | REF | 75% |
| 2239 | s33 | REF | 75% |
| 2240 | s33 | REF | 70% |
| 2241 | s33 | SNP | 65% |
| 2242 | s33 | REF | 70% |
| 2243 | s33 | REF | 70% |
| 2244 | s33 | REF | 70% |
| 2245 | s33 | SNP | 65% |
| 2246 | s33 | REF | 70% |
| 2247 | s33 | REF | 70% |
| 2248 | s33 | REF | 70% |
| 2249 | s33 | SNP | 65% |
| 2250 | s34 | SNP | 45% |
| 2251 | s34 | REF | 50% |
| 2252 | s34 | REF | 35% |
| 2253 | s34 | SNP | 30% |
| 2254 | s34 | SNP | 45% |
| 2255 | s34 | REF | 50% |
| 2256 | s34 | SNP | 45% |
| 2257 | s34 | REF | 50% |
| 2258 | s34 | REF | 40% |
| 2259 | s34 | SNP | 35% |
| 2260 | s34 | SNP | 35% |
| 2261 | s34 | REF | 40% |
| 2262 | s34 | SNP | 50% |
| 2263 | s34 | SNP | 35% |
| 2264 | s34 | SNP | 55% |
| 2265 | s34 | REF | 55% |
| 2266 | s34 | SNP | 50% |
| 2267 | s34 | REF | 55% |
| 2268 | s34 | REF | 40% |
| 2269 | s34 | SNP | 35% |
| 2270 | s34 | REF | 50% |
| 2271 | s34 | SNP | 45% |
| 2272 | s34 | REF | 40% |
| 2273 | s34 | REF | 45% |
| 2274 | s34 | SNP | 40% |
| 2275 | s34 | REF | 50% |
| 2276 | s34 | SNP | 45% |
| 2277 | s34 | REF | 50% |
| 2278 | s34 | SNP | 45% |
| 2279 | s34 | REF | 55% |
| 2280 | s34 | SNP | 50% |
| 2281 | s34 | REF | 50% |
| 2282 | s34 | SNP | 45% |
| 2283 | s34 | SNP | 45% |
| 2284 | s34 | REF | 50% |
| 2285 | s34 | REF | 45% |
| 2286 | s34 | REF | 55% |
| 2287 | s34 | SNP | 50% |
| 2288 | s34 | SNP | 40% |
| 2289 | s34 | REF | 45% |
| 2290 | s34 | REF | 60% |
| 2291 | s34 | SNP | 55% |
| 2292 | s34 | REF | 50% |
| 2293 | s34 | SNP | 45% |
| 2294 | s34 | SNP | 45% |
| 2295 | s34 | REF | 50% |
| 2296 | s34 | REF | 60% |
| 2297 | s34 | SNP | 35% |
| 2298 | s34 | REF | 40% |
| 2299 | s34 | SNP | 55% |
| 2300 | s34 | SNP | 45% |
| 2301 | s34 | REF | 50% |
| 2302 | s34 | SNP | 45% |
| 2303 | s34 | SNP | 45% |
| 2304 | s34 | REF | 50% |
| 2305 | s34 | REF | 60% |
| 2306 | s34 | SNP | 55% |
| 2307 | s34 | REF | 60% |
| 2308 | s35 | REF | 50% |
| 2309 | s35 | SNP | 50% |
| 2310 | s35 | REF | 65% |
| 2311 | s35 | SNP | 65% |
| 2312 | s35 | SNP | 65% |
| 2313 | s35 | REF | 65% |
| 2314 | s35 | REF | 50% |
| 2315 | s35 | SNP | 50% |
| 2316 | s35 | REF | 50% |
| 2317 | s35 | SNP | 50% |
| 2318 | s35 | SNP | 50% |
| 2319 | s35 | REF | 50% |
| 2320 | s35 | REF | 65% |
| 2321 | s35 | SNP | 65% |
| 2322 | s35 | SNP | 50% |
| 2323 | s35 | SNP | 70% |
| 2324 | s35 | REF | 70% |
| 2325 | s35 | REF | 50% |
| 2326 | s35 | SNP | 50% |
| 2327 | s35 | SNP | 50% |
| 2328 | s35 | REF | 50% |
| 2329 | s35 | REF | 65% |
| 2330 | s35 | REF | 65% |
| 2331 | s35 | SNP | 65% |
| 2332 | s35 | SNP | 50% |
| 2333 | s35 | REF | 50% |
| 2334 | s35 | SNP | 50% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 2335 | s35 | SNP | 65% |
| 2336 | s35 | REF | 65% |
| 2337 | s35 | SNP | 60% |
| 2338 | s35 | REF | 60% |
| 2339 | s35 | SNP | 65% |
| 2340 | s35 | REF | 65% |
| 2341 | s35 | SNP | 65% |
| 2342 | s35 | REF | 65% |
| 2343 | s35 | SNP | 50% |
| 2344 | s35 | REF | 50% |
| 2345 | s35 | SNP | 55% |
| 2346 | s35 | REF | 55% |
| 2347 | s35 | REF | 50% |
| 2348 | s35 | SNP | 50% |
| 2349 | s35 | REF | 65% |
| 2350 | s35 | REF | 65% |
| 2351 | s35 | SNP | 65% |
| 2352 | s35 | SNP | 50% |
| 2353 | s35 | REF | 50% |
| 2354 | s35 | REF | 50% |
| 2355 | s35 | SNP | 65% |
| 2356 | s35 | REF | 65% |
| 2357 | s35 | SNP | 50% |
| 2358 | s35 | REF | 50% |
| 2359 | s35 | REF | 50% |
| 2360 | s35 | SNP | 50% |
| 2361 | s35 | REF | 70% |
| 2362 | s35 | REF | 50% |
| 2363 | s35 | SNP | 50% |
| 2364 | s35 | REF | 50% |
| 2365 | s35 | SNP | 50% |
| 2366 | s35 | REF | 60% |
| 2367 | s35 | SNP | 60% |
| 2368 | s35 | REF | 50% |
| 2369 | s35 | SNP | 50% |
| 2370 | s35 | SNP | 65% |
| 2371 | s35 | REF | 65% |
| 2372 | s35 | SNP | 50% |
| 2373 | s35 | SNP | 65% |
| 2374 | s35 | SNP | 50% |
| 2375 | s35 | REF | 50% |
| 2376 | s35 | REF | 50% |
| 2377 | s35 | SNP | 50% |
| 2378 | s35 | REF | 50% |
| 2379 | s35 | REF | 65% |
| 2380 | s35 | SNP | 65% |
| 2381 | s35 | REF | 55% |
| 2382 | s35 | SNP | 55% |
| 2383 | s36 | SNP | 50% |
| 2384 | s36 | REF | 45% |
| 2385 | s36 | REF | 40% |
| 2386 | s36 | SNP | 40% |
| 2387 | s36 | REF | 35% |
| 2388 | s36 | SNP | 55% |
| 2389 | s36 | REF | 50% |
| 2390 | s36 | REF | 55% |
| 2391 | s36 | SNP | 60% |
| 2392 | s36 | REF | 45% |
| 2393 | s36 | SNP | 50% |
| 2394 | s36 | REF | 40% |
| 2395 | s36 | REF | 55% |
| 2396 | s36 | SNP | 60% |
| 2397 | s36 | SNP | 45% |
| 2398 | s36 | SNP | 60% |
| 2399 | s36 | REF | 55% |
| 2400 | s36 | SNP | 60% |
| 2401 | s36 | REF | 55% |
| 2402 | s36 | SNP | 45% |
| 2403 | s36 | REF | 55% |
| 2404 | s36 | SNP | 60% |
| 2405 | s36 | REF | 45% |
| 2406 | s36 | REF | 60% |
| 2407 | s36 | SNP | 65% |
| 2408 | s36 | SNP | 45% |
| 2409 | s36 | REF | 40% |
| 2410 | s36 | REF | 50% |
| 2411 | s36 | SNP | 55% |
| 2412 | s36 | REF | 55% |
| 2413 | s36 | SNP | 60% |
| 2414 | s36 | SNP | 65% |
| 2415 | s36 | REF | 60% |
| 2416 | s36 | SNP | 60% |
| 2417 | s36 | REF | 55% |
| 2418 | s36 | SNP | 60% |
| 2419 | s36 | SNP | 45% |
| 2420 | s36 | REF | 40% |
| 2421 | s36 | REF | 40% |
| 2422 | s36 | SNP | 65% |
| 2423 | s36 | REF | 45% |
| 2424 | s36 | SNP | 50% |
| 2425 | s36 | SNP | 50% |
| 2426 | s36 | REF | 45% |
| 2427 | s36 | SNP | 45% |
| 2428 | s36 | SNP | 60% |
| 2429 | s36 | REF | 55% |
| 2430 | s36 | REF | 60% |
| 2431 | s36 | REF | 55% |
| 2432 | s36 | SNP | 60% |
| 2433 | s36 | SNP | 60% |
| 2434 | s36 | REF | 55% |
| 2435 | s36 | SNP | 60% |
| 2436 | s36 | REF | 55% |
| 2437 | s37 | SNP | 70% |
| 2438 | s37 | SNP | 75% |
| 2439 | s37 | SNP | 75% |
| 2440 | s37 | SNP | 80% |
| 2441 | s37 | SNP | 80% |
| 2442 | s37 | SNP | 75% |
| 2443 | s37 | SNP | 70% |
| 2444 | s37 | SNP | 75% |
| 2445 | s37 | SNP | 70% |
| 2446 | s37 | REF | 70% |
| 2447 | s37 | SNP | 80% |
| 2448 | s37 | SNP | 75% |
| 2449 | s37 | REF | 70% |
| 2450 | s37 | SNP | 70% |
| 2451 | s37 | SNP | 75% |
| 2452 | s37 | SNP | 75% |
| 2453 | s37 | SNP | 70% |
| 2454 | s37 | SNP | 75% |
| 2455 | s37 | REF | 70% |
| 2456 | s37 | SNP | 75% |
| 2457 | s37 | SNP | 80% |
| 2458 | s37 | SNP | 75% |
| 2459 | s37 | SNP | 75% |
| 2460 | s37 | SNP | 75% |
| 2461 | s37 | SNP | 70% |
| 2462 | s37 | SNP | 75% |
| 2463 | s37 | SNP | 75% |
| 2464 | s37 | SNP | 70% |
| 2465 | s37 | SNP | 70% |
| 2466 | s37 | REF | 70% |
| 2467 | s37 | SNP | 75% |
| 2468 | s38 | SNP | 55% |
| 2469 | s38 | SNP | 55% |
| 2470 | s38 | REF | 55% |
| 2471 | s38 | SNP | 60% |
| 2472 | s38 | REF | 60% |
| 2473 | s38 | REF | 60% |
| 2474 | s38 | SNP | 60% |
| 2475 | s38 | SNP | 45% |
| 2476 | s38 | REF | 45% |
| 2477 | s38 | SNP | 55% |
| 2478 | s38 | REF | 55% |
| 2479 | s38 | SNP | 65% |
| 2480 | s38 | REF | 65% |
| 2481 | s38 | SNP | 60% |
| 2482 | s38 | REF | 60% |
| 2483 | s38 | SNP | 60% |
| 2484 | s38 | SNP | 60% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 2485 | s38 | REF | 60% |
| 2486 | s38 | REF | 60% |
| 2487 | s38 | SNP | 60% |
| 2488 | s38 | SNP | 60% |
| 2489 | s38 | REF | 60% |
| 2490 | s38 | REF | 60% |
| 2491 | s38 | SNP | 60% |
| 2492 | s38 | REF | 60% |
| 2493 | s38 | SNP | 60% |
| 2494 | s38 | SNP | 60% |
| 2495 | s38 | REF | 60% |
| 2496 | s38 | REF | 55% |
| 2497 | s38 | SNP | 55% |
| 2498 | s38 | REF | 50% |
| 2499 | s38 | SNP | 50% |
| 2500 | s38 | REF | 60% |
| 2501 | s38 | REF | 60% |
| 2502 | s38 | SNP | 60% |
| 2503 | s38 | SNP | 55% |
| 2504 | s38 | REF | 55% |
| 2505 | s38 | REF | 55% |
| 2506 | s38 | SNP | 55% |
| 2507 | s38 | REF | 60% |
| 2508 | s38 | SNP | 60% |
| 2509 | s38 | SNP | 60% |
| 2510 | s38 | REF | 55% |
| 2511 | s38 | SNP | 55% |
| 2512 | s38 | REF | 60% |
| 2513 | s38 | SNP | 60% |
| 2514 | s38 | REF | 55% |
| 2515 | s38 | SNP | 55% |
| 2516 | s38 | SNP | 50% |
| 2517 | s38 | REF | 50% |
| 2518 | s38 | SNP | 45% |
| 2519 | s38 | REF | 45% |
| 2520 | s39 | SNP | 65% |
| 2521 | s39 | REF | 70% |
| 2522 | s39 | REF | 70% |
| 2523 | s39 | REF | 80% |
| 2524 | s39 | SNP | 75% |
| 2525 | s39 | SNP | 65% |
| 2526 | s39 | REF | 70% |
| 2527 | s39 | REF | 80% |
| 2528 | s39 | SNP | 75% |
| 2529 | s39 | REF | 80% |
| 2530 | s39 | SNP | 75% |
| 2531 | s39 | SNP | 65% |
| 2532 | s39 | REF | 70% |
| 2533 | s39 | REF | 75% |
| 2534 | s39 | SNP | 70% |
| 2535 | s39 | REF | 70% |
| 2536 | s39 | SNP | 65% |
| 2537 | s39 | REF | 70% |
| 2538 | s39 | SNP | 75% |
| 2539 | s39 | REF | 80% |
| 2540 | s39 | SNP | 75% |
| 2541 | s39 | REF | 80% |
| 2542 | s39 | REF | 75% |
| 2543 | s39 | SNP | 70% |
| 2544 | s39 | REF | 80% |
| 2545 | s39 | REF | 75% |
| 2546 | s39 | REF | 75% |
| 2547 | s39 | SNP | 70% |
| 2548 | s39 | REF | 70% |
| 2549 | s39 | SNP | 65% |
| 2550 | s39 | REF | 75% |
| 2551 | s39 | SNP | 65% |
| 2552 | s39 | SNP | 65% |
| 2553 | s39 | REF | 70% |
| 2554 | s40 | REF | 65% |
| 2555 | s40 | SNP | 70% |
| 2556 | s40 | REF | 70% |
| 2557 | s40 | SNP | 75% |
| 2558 | s40 | REF | 65% |
| 2559 | s40 | REF | 65% |
| 2560 | s40 | REF | 70% |
| 2561 | s40 | SNP | 75% |
| 2562 | s40 | REF | 65% |
| 2563 | s40 | SNP | 70% |
| 2564 | s40 | REF | 70% |
| 2565 | s40 | SNP | 75% |
| 2566 | s40 | SNP | 75% |
| 2567 | s40 | REF | 70% |
| 2568 | s40 | SNP | 75% |
| 2569 | s40 | SNP | 75% |
| 2570 | s40 | REF | 70% |
| 2571 | s40 | SNP | 70% |
| 2572 | s40 | REF | 65% |
| 2573 | s40 | SNP | 70% |
| 2574 | s40 | SNP | 70% |
| 2575 | s40 | REF | 65% |
| 2576 | s40 | REF | 65% |
| 2577 | s40 | SNP | 70% |
| 2578 | s40 | SNP | 75% |
| 2579 | s40 | REF | 70% |
| 2580 | s40 | REF | 70% |
| 2581 | s40 | SNP | 75% |
| 2582 | s40 | REF | 70% |
| 2583 | s40 | SNP | 75% |
| 2584 | s40 | REF | 70% |
| 2585 | s40 | SNP | 75% |
| 2586 | s40 | REF | 70% |
| 2587 | s40 | SNP | 70% |
| 2588 | s40 | REF | 65% |
| 2589 | s40 | SNP | 70% |
| 2590 | s40 | REF | 65% |
| 2591 | s40 | SNP | 70% |
| 2592 | s40 | SNP | 70% |
| 2593 | s40 | REF | 65% |
| 2594 | s40 | SNP | 70% |
| 2595 | s40 | REF | 65% |
| 2596 | s40 | REF | 60% |
| 2597 | s40 | REF | 65% |
| 2598 | s40 | SNP | 70% |
| 2599 | s40 | SNP | 65% |
| 2600 | s40 | SNP | 70% |
| 2601 | s40 | REF | 65% |
| 2602 | s40 | REF | 70% |
| 2603 | s40 | SNP | 70% |
| 2604 | s40 | REF | 65% |
| 2605 | s41 | SNP | 45% |
| 2606 | s41 | SNP | 35% |
| 2607 | s41 | SNP | 45% |
| 2608 | s41 | SNP | 45% |
| 2609 | s41 | SNP | 40% |
| 2610 | s42 | SNP | 40% |
| 2611 | s42 | REF | 35% |
| 2612 | s42 | REF | 35% |
| 2613 | s42 | SNP | 40% |
| 2614 | s42 | SNP | 60% |
| 2615 | s42 | REF | 45% |
| 2616 | s42 | SNP | 50% |
| 2617 | s42 | REF | 45% |
| 2618 | s42 | SNP | 50% |
| 2619 | s42 | REF | 55% |
| 2620 | s42 | SNP | 50% |
| 2621 | s42 | REF | 45% |
| 2622 | s42 | SNP | 45% |
| 2623 | s42 | REF | 40% |
| 2624 | s42 | REF | 45% |
| 2625 | s42 | SNP | 50% |
| 2626 | s42 | REF | 45% |
| 2627 | s42 | SNP | 50% |
| 2628 | s42 | SNP | 50% |
| 2629 | s42 | REF | 45% |
| 2630 | s42 | REF | 30% |
| 2631 | s42 | SNP | 35% |
| 2632 | s42 | REF | 30% |
| 2633 | s42 | SNP | 35% |
| 2634 | s42 | SNP | 60% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 2635 | s42 | REF | 55% |
| 2636 | s42 | REF | 35% |
| 2637 | s42 | SNP | 40% |
| 2638 | s42 | REF | 55% |
| 2639 | s42 | SNP | 60% |
| 2640 | s42 | REF | 55% |
| 2641 | s42 | SNP | 60% |
| 2642 | s42 | REF | 60% |
| 2643 | s42 | SNP | 65% |
| 2644 | s42 | SNP | 65% |
| 2645 | s42 | SNP | 35% |
| 2646 | s42 | REF | 30% |
| 2647 | s42 | SNP | 50% |
| 2648 | s42 | REF | 45% |
| 2649 | s42 | SNP | 40% |
| 2650 | s42 | REF | 35% |
| 2651 | s42 | REF | 45% |
| 2652 | s42 | SNP | 50% |
| 2653 | s42 | REF | 40% |
| 2654 | s42 | SNP | 45% |
| 2655 | s42 | SNP | 55% |
| 2656 | s42 | REF | 50% |
| 2657 | s42 | SNP | 30% |
| 2658 | s42 | SNP | 35% |
| 2659 | s42 | REF | 30% |
| 2660 | s42 | REF | 60% |
| 2661 | s42 | SNP | 50% |
| 2662 | s42 | REF | 45% |
| 2663 | s42 | SNP | 45% |
| 2664 | s42 | REF | 40% |
| 2665 | s43 | SNP | 60% |
| 2666 | s43 | REF | 55% |
| 2667 | s43 | SNP | 65% |
| 2668 | s43 | REF | 60% |
| 2669 | s43 | REF | 60% |
| 2670 | s43 | SNP | 65% |
| 2671 | s43 | SNP | 65% |
| 2672 | s43 | REF | 60% |
| 2673 | s43 | SNP | 60% |
| 2674 | s43 | REF | 55% |
| 2675 | s43 | REF | 50% |
| 2676 | s43 | SNP | 55% |
| 2677 | s43 | SNP | 65% |
| 2678 | s43 | REF | 60% |
| 2679 | s43 | REF | 60% |
| 2680 | s43 | SNP | 65% |
| 2681 | s43 | SNP | 60% |
| 2682 | s43 | REF | 55% |
| 2683 | s43 | REF | 65% |
| 2684 | s43 | SNP | 70% |
| 2685 | s43 | REF | 55% |
| 2686 | s43 | SNP | 60% |
| 2687 | s43 | REF | 55% |
| 2688 | s43 | SNP | 60% |
| 2689 | s43 | SNP | 70% |
| 2690 | s43 | REF | 65% |
| 2691 | s43 | SNP | 65% |
| 2692 | s43 | SNP | 60% |
| 2693 | s43 | REF | 55% |
| 2694 | s43 | REF | 60% |
| 2695 | s43 | SNP | 70% |
| 2696 | s43 | REF | 65% |
| 2697 | s43 | REF | 60% |
| 2698 | s43 | SNP | 65% |
| 2699 | s43 | REF | 55% |
| 2700 | s43 | SNP | 60% |
| 2701 | s43 | SNP | 65% |
| 2702 | s43 | REF | 60% |
| 2703 | s43 | REF | 55% |
| 2704 | s43 | SNP | 60% |
| 2705 | s43 | SNP | 70% |
| 2706 | s43 | REF | 65% |
| 2707 | s43 | SNP | 65% |
| 2708 | s43 | REF | 65% |
| 2709 | s43 | SNP | 70% |
| 2710 | s43 | SNP | 70% |
| 2711 | s43 | REF | 65% |
| 2712 | s43 | REF | 65% |
| 2713 | s43 | SNP | 70% |
| 2714 | s43 | REF | 65% |
| 2715 | s43 | SNP | 70% |
| 2716 | s43 | REF | 60% |
| 2717 | s43 | SNP | 65% |
| 2718 | s43 | SNP | 60% |
| 2719 | s43 | REF | 55% |
| 2720 | s43 | REF | 60% |
| 2721 | s43 | SNP | 65% |
| 2722 | s43 | SNP | 55% |
| 2723 | s43 | REF | 50% |
| 2724 | s43 | REF | 60% |
| 2725 | s44 | REF | 55% |
| 2726 | s44 | REF | 55% |
| 2727 | s44 | REF | 55% |
| 2728 | s44 | REF | 60% |
| 2729 | s44 | REF | 60% |
| 2730 | s44 | REF | 55% |
| 2731 | s44 | REF | 55% |
| 2732 | s44 | REF | 60% |
| 2733 | s44 | REF | 60% |
| 2734 | s44 | REF | 60% |
| 2735 | s44 | REF | 55% |
| 2736 | s44 | SNP | 50% |
| 2737 | s44 | REF | 60% |
| 2738 | s44 | REF | 60% |
| 2739 | s44 | REF | 60% |
| 2740 | s44 | REF | 60% |
| 2741 | s44 | REF | 55% |
| 2742 | s44 | REF | 60% |
| 2743 | s44 | REF | 60% |
| 2744 | s44 | REF | 55% |
| 2745 | s44 | REF | 55% |
| 2746 | s44 | REF | 55% |
| 2747 | s44 | REF | 55% |
| 2748 | s44 | REF | 55% |
| 2749 | s44 | REF | 55% |
| 2750 | s44 | REF | 55% |
| 2751 | s44 | REF | 50% |
| 2752 | s44 | REF | 55% |
| 2753 | s45 | REF | 75% |
| 2754 | s45 | REF | 75% |
| 2755 | s45 | SNP | 70% |
| 2756 | s45 | SNP | 70% |
| 2757 | s45 | SNP | 70% |
| 2758 | s45 | SNP | 70% |
| 2759 | s45 | REF | 75% |
| 2760 | s45 | SNP | 70% |
| 2761 | s45 | REF | 80% |
| 2762 | s45 | SNP | 75% |
| 2763 | s45 | REF | 80% |
| 2764 | s45 | SNP | 75% |
| 2765 | s45 | REF | 80% |
| 2766 | s45 | REF | 75% |
| 2767 | s45 | REF | 75% |
| 2768 | s45 | REF | 75% |
| 2769 | s45 | REF | 75% |
| 2770 | s45 | REF | 75% |
| 2771 | s45 | REF | 80% |
| 2772 | s45 | SNP | 75% |
| 2773 | s45 | SNP | 70% |
| 2774 | s45 | REF | 80% |
| 2775 | s45 | REF | 75% |
| 2776 | s45 | SNP | 75% |
| 2777 | s45 | REF | 75% |
| 2778 | s45 | SNP | 70% |
| 2779 | s45 | REF | 80% |
| 2780 | s45 | SNP | 75% |
| 2781 | s45 | REF | 75% |
| 2782 | s45 | REF | 75% |
| 2783 | s45 | SNP | 70% |
| 2784 | s45 | SNP | 75% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 2785 | s45 | REF | 80% |
| 2786 | s45 | SNP | 75% |
| 2787 | s45 | REF | 80% |
| 2788 | s45 | SNP | 70% |
| 2789 | s45 | REF | 75% |
| 2790 | s45 | REF | 75% |
| 2791 | s45 | REF | 75% |
| 2792 | s45 | SNP | 70% |
| 2793 | s45 | REF | 75% |
| 2794 | s45 | SNP | 70% |
| 2795 | s45 | REF | 75% |
| 2796 | s46 | SNP | 55% |
| 2797 | s46 | REF | 65% |
| 2798 | s46 | SNP | 60% |
| 2799 | s46 | SNP | 65% |
| 2800 | s46 | REF | 70% |
| 2801 | s46 | REF | 65% |
| 2802 | s46 | SNP | 60% |
| 2803 | s46 | SNP | 65% |
| 2804 | s46 | REF | 70% |
| 2805 | s46 | REF | 70% |
| 2806 | s46 | SNP | 60% |
| 2807 | s46 | SNP | 60% |
| 2808 | s46 | REF | 65% |
| 2809 | s46 | SNP | 65% |
| 2810 | s46 | REF | 70% |
| 2811 | s46 | SNP | 65% |
| 2812 | s46 | REF | 70% |
| 2813 | s46 | SNP | 65% |
| 2814 | s46 | REF | 70% |
| 2815 | s46 | REF | 75% |
| 2816 | s46 | SNP | 70% |
| 2817 | s46 | SNP | 65% |
| 2818 | s46 | REF | 70% |
| 2819 | s46 | REF | 70% |
| 2820 | s46 | SNP | 65% |
| 2821 | s46 | REF | 70% |
| 2822 | s46 | REF | 65% |
| 2823 | s46 | SNP | 60% |
| 2824 | s46 | SNP | 60% |
| 2825 | s46 | REF | 65% |
| 2826 | s46 | REF | 70% |
| 2827 | s46 | SNP | 65% |
| 2828 | s46 | SNP | 65% |
| 2829 | s46 | REF | 70% |
| 2830 | s46 | REF | 65% |
| 2831 | s46 | SNP | 60% |
| 2832 | s46 | SNP | 65% |
| 2833 | s46 | REF | 70% |
| 2834 | s46 | SNP | 65% |
| 2835 | s46 | REF | 70% |
| 2836 | s46 | REF | 70% |
| 2837 | s46 | SNP | 65% |
| 2838 | s46 | SNP | 70% |
| 2839 | s46 | REF | 75% |
| 2840 | s46 | SNP | 60% |
| 2841 | s46 | REF | 65% |
| 2842 | s46 | REF | 70% |
| 2843 | s46 | SNP | 65% |
| 2844 | s46 | REF | 70% |
| 2845 | s46 | REF | 70% |
| 2846 | s46 | SNP | 65% |
| 2847 | s46 | REF | 70% |
| 2848 | s46 | SNP | 65% |
| 2849 | s46 | REF | 65% |
| 2850 | s46 | SNP | 65% |
| 2851 | s46 | SNP | 60% |
| 2852 | s47 | REF | 65% |
| 2853 | s47 | REF | 60% |
| 2854 | s47 | REF | 70% |
| 2855 | s47 | SNP | 80% |
| 2856 | s47 | REF | 75% |
| 2857 | s47 | REF | 65% |
| 2858 | s47 | REF | 60% |
| 2859 | s47 | SNP | 80% |
| 2860 | s47 | REF | 75% |
| 2861 | s47 | REF | 70% |
| 2862 | s47 | SNP | 75% |
| 2863 | s47 | REF | 75% |
| 2864 | s47 | REF | 75% |
| 2865 | s47 | REF | 65% |
| 2866 | s47 | SNP | 70% |
| 2867 | s47 | SNP | 65% |
| 2868 | s47 | SNP | 65% |
| 2869 | s47 | REF | 55% |
| 2870 | s47 | REF | 70% |
| 2871 | s47 | SNP | 60% |
| 2872 | s47 | SNP | 70% |
| 2873 | s47 | REF | 65% |
| 2874 | s47 | SNP | 65% |
| 2875 | s47 | REF | 60% |
| 2876 | s47 | SNP | 80% |
| 2877 | s47 | SNP | 80% |
| 2878 | s47 | REF | 75% |
| 2879 | s47 | SNP | 80% |
| 2880 | s47 | REF | 75% |
| 2881 | s47 | REF | 55% |
| 2882 | s47 | SNP | 75% |
| 2883 | s47 | REF | 70% |
| 2884 | s47 | SNP | 60% |
| 2885 | s47 | REF | 75% |
| 2886 | s48 | REF | 50% |
| 2887 | s48 | SNP | 65% |
| 2888 | s48 | REF | 65% |
| 2889 | s48 | REF | 50% |
| 2890 | s48 | SNP | 50% |
| 2891 | s48 | REF | 45% |
| 2892 | s48 | SNP | 45% |
| 2893 | s48 | REF | 60% |
| 2894 | s48 | REF | 65% |
| 2895 | s48 | SNP | 65% |
| 2896 | s48 | SNP | 70% |
| 2897 | s48 | REF | 65% |
| 2898 | s48 | REF | 70% |
| 2899 | s48 | SNP | 70% |
| 2900 | s48 | REF | 70% |
| 2901 | s48 | SNP | 55% |
| 2902 | s48 | REF | 55% |
| 2903 | s48 | REF | 50% |
| 2904 | s48 | SNP | 50% |
| 2905 | s48 | REF | 45% |
| 2906 | s48 | SNP | 45% |
| 2907 | s48 | REF | 65% |
| 2908 | s48 | SNP | 65% |
| 2909 | s48 | REF | 50% |
| 2910 | s48 | SNP | 50% |
| 2911 | s49 | REF | 65% |
| 2912 | s49 | REF | 65% |
| 2913 | s49 | SNP | 55% |
| 2914 | s49 | REF | 65% |
| 2915 | s49 | SNP | 55% |
| 2916 | s49 | REF | 70% |
| 2917 | s49 | SNP | 55% |
| 2918 | s49 | REF | 60% |
| 2919 | s49 | REF | 60% |
| 2920 | s49 | REF | 70% |
| 2921 | s49 | REF | 60% |
| 2922 | s49 | REF | 60% |
| 2923 | s49 | REF | 65% |
| 2924 | s49 | REF | 65% |
| 2925 | s49 | REF | 65% |
| 2926 | s50 | SNP | 60% |
| 2927 | s50 | REF | 65% |
| 2928 | s50 | SNP | 60% |
| 2929 | s50 | REF | 60% |
| 2930 | s50 | SNP | 55% |
| 2931 | s50 | SNP | 55% |
| 2932 | s50 | REF | 60% |
| 2933 | s50 | REF | 65% |
| 2934 | s50 | REF | 60% |

TABLE 2-continued

Guide sequences designed to associate with specific SNPs of the IMPDH1 gene

| SEQ ID NO: | SNP ID (Table 1) | Target (SNP/REF) | % GC |
|---|---|---|---|
| 2935 | s50 | SNP | 55% |
| 2936 | s50 | REF | 60% |
| 2937 | s48 | REF | 60% |
| 2938 | s48 | SNP | 60% |
| 2939 | s48 | SNP | 50% |
| 2940 | s48 | REF | 50% |
| 2941 | s48 | SNP | 65% |
| 2942 | s48 | REF | 65% |
| 2943 | s48 | REF | 70% |
| 2944 | s48 | SNP | 70% |
| 2945 | s48 | REF | 65% |
| 2946 | s48 | REF | 65% |
| 2947 | s48 | SNP | 65% |
| 2948 | s48 | SNP | 65% |
| 2949 | s48 | REF | 65% |
| 2950 | s48 | REF | 70% |
| 2951 | s48 | SNP | 70% |
| 2952 | s48 | SNP | 70% |
| 2953 | s48 | REF | 65% |
| 2954 | s48 | SNP | 65% |
| 2955 | s48 | REF | 70% |
| 2956 | s48 | SNP | 60% |
| 2957 | s48 | REF | 60% |
| 2958 | s48 | SNP | 65% |
| 2959 | s48 | REF | 65% |
| 2960 | s48 | REF | 70% |
| 2961 | s48 | SNP | 70% |
| 2962 | s48 | SNP | 70% |
| 2963 | s48 | REF | 70% |
| 2964 | s48 | REF | 75% |
| 2965 | s48 | SNP | 75% |
| 2966 | s48 | REF | 75% |
| 2967 | s48 | REF | 70% |
| 2968 | s48 | SNP | 60% |
| 2969 | s48 | REF | 60% |
| 2970 | s48 | SNP | 60% |
| 2971 | s48 | REF | 70% |
| 2972 | s51 | SNP | 55% |
| 2973 | s51 | SNP | 60% |
| 2974 | s51 | REF | 55% |
| 2975 | s51 | REF | 50% |
| 2976 | s51 | SNP | 55% |
| 2977 | s51 | REF | 55% |
| 2978 | s51 | REF | 55% |
| 2979 | s51 | SNP | 60% |
| 2980 | s51 | SNP | 65% |
| 2981 | s51 | REF | 60% |
| 2982 | s51 | SNP | 55% |
| 2983 | s51 | REF | 50% |
| 2984 | s51 | REF | 55% |
| 2985 | s51 | SNP | 60% |
| 2986 | s51 | REF | 45% |
| 2987 | s51 | SNP | 50% |
| 2988 | s51 | REF | 50% |
| 2989 | s51 | SNP | 55% |
| 2990 | s51 | REF | 60% |
| 2991 | s51 | REF | 45% |
| 2992 | s51 | SNP | 50% |
| 2993 | s51 | REF | 45% |
| 2994 | s51 | SNP | 50% |
| 2995 | s51 | SNP | 65% |
| 2996 | s51 | SNP | 60% |
| 2997 | s51 | SNP | 60% |
| 2998 | s51 | REF | 55% |
| 2999 | s51 | REF | 55% |
| 3000 | s51 | SNP | 60% |
| 3001 | s51 | SNP | 55% |
| 3002 | s51 | REF | 50% |
| 3003 | s51 | SNP | 55% |
| 3004 | s51 | REF | 45% |
| 3005 | s51 | SNP | 50% |
| 3006 | s51 | SNP | 60% |
| 3007 | s51 | REF | 55% |
| 3008 | s51 | SNP | 60% |
| 3009 | s51 | REF | 55% |
| 3010 | s51 | REF | 50% |

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only.

Experimental Details

EXAMPLE 1

IMDPH1 Correction Anaylsis

Guide sequences comprising 17-20 nucleotides in the sequences of 17-20 contiguous nucleotides set forth in SEQ ID NOs: 1-3010 are screened for high on target activity. On target activity is determined by DNA capillary electrophoresis analysis.

According to DNA capillary electrophoresis analysis, guide sequences comprising 17-20 nucleotides in the sequences of 17-20 contiguous nucleotides set forth in SEQ ID NOs: 1-3010 are found to be suitable for correction of the IMDPH1 gene.

Discussion

The guide sequences of the present invention are determined to be suitable for targeting the IMDPH1 gene.

REFERENCES

1. Ahmad and Allen (1992) "Antibody-mediated Specific Binging and Cytotoxicity of Lipsome-entrapped Doxorubicin to Lung Cancer Cells in Vitro", Cancer Research 52:4817-20
2. Anders (1992) "Human gene therapy", Science 256: 808-13
3. Basha et al. (2011) "Influence of Cationic Lipid Composition on Gene Silencing Properties of Lipid Nanoparticle Formulations of siRNA in Antigen-Presenting Cells", Mol. Ther. 19(12):2186-200
4. Behr (1994) Gene transfer with synthetic cationic amphiphiles: Prospects for gene therapy", Bioconjuage Chem 5:382-89
5. Blaese (1995) "Vectors in cancer therapy: how will they deliver", Cancer Gene Ther. 2:291-97
6. Blaese et al. (1995) "T lympocyte-directed gene therapy for ADA-SCID: initial trial results after 4 years", Science 270(5235):475-80
7. Buchschacher and Panganiban (1992) "Human immunodeficiency virus vectors for inducible expression of foreign genes", J. Virol. 66:2731-39
8. Burstein et al. (2017) "New CRISPR-Cas systems from uncultivated microbes", Nature 542:237-41
9. Chung et al. (2006) "Agrobacterium is not alone: gene transfer to plants by viruses and other bacteria", Trends Plant Sci. 11(1):1-4

10. Coelho et al. (2013) "Safety and Efficacy of RNAi Therapy for Transthyretin Amyloidosis", N Engl J. Med 369:819-29
11. Crystal (1995) "Transfer of genes to humans: early lessons and obstacles to success", Science 270(5235): 404-10
12. Dillon (1993) "Regulation gene expression in gene therapy" Trends in Biotechnology 11(5):167-173
13. Dranoff et al. (1997) "A phase I study of vaccination with autologous, irradiated melanoma cells engineered to secrete human granulocyte macrophage colony stimulating factor", Hum. Gene Ther. 8(1):111-23
14. Dunbar et al. (1995) "Retrovirally marked CD34-enriched peripheral blood and bone marrow cells contribute to long-term engraftment after autologous transplantation", Blood 85:3048-57
15. Ellem et al. (1997) "A case report: immune responses and clinical course of the first human use of ganulocyte/macrophage-colony-stimulating-factor-tranduced autologous melanoma cells for immunotherapy", Cancer Immunol Immunother 44:10-20
16. Gao and Huang (1995) "Cationic liposome-mediated gene transfer" Gene Ther. 2(10):710-22
17. Haddada et al. (1995) "Gene Therapy Using Adenovirus Vectors", in: The Molecular Repertoire of Adenoviruses III: Biology and Pathogenesis, ed. Doerfler and Böhm, pp. 297-306
18. Han et al. (1995) "Ligand-directed retro-viral targeting of human breast cancer cells", Proc Natl Acad Sci U.S.A. 92(21):9747-51
19. Inaba et al. (1992) "Generation of large numbers of dendritic cells from mouse bone marrow cultures supplemented with granulocyte/macrophage colony-stimulating factor", J Exp Med. 176(6):1693-702
20. Jinek et al. (2012) "A programmable dual-RNA-guided DNA endonuclease in adaptive bacterial immunity," Science 337(6096):816-21
21. Johan et al. (1992) "GLVR1, a receptor for gibbon ape leukemia virus, is homologous to a phosphate permease of Neurospora crassa and is expressed at high levels in the brain and thymus", J Virol 66(3):1635-40
22. Judge et al. (2006) "Design of noninflammatory synthetic siRNA mediating potent gene silencing in vivo", Mol Ther. 13(3):494-505
23. Kohn et al. (1995) "Engraftment of gene-modified umbilical cord blood cells in neonates with adnosine deaminase deficiency", Nature Medicine 1:1017-23
24. Kremer and Perricaudet (1995) "Adenovirus and adeno-associated virus mediated gene transfer", Br. Med. Bull. 51(1):31-44
25. Macdiarmid et al. (2009) "Sequential treatment of drug-resistant tumors with targeted minicells containing siRNA or a cytotoxic drug", Nat Biotehcnol. 27(7):643-51
26. Malech et al. (1997) "Prolonged production of NADPH oxidase-corrected granulocyes after gene therapy of chronic granulomatous disease", PNAS 94(22):12133-38
27. Miller et al. (1991) "Construction and properties of retrovirus packaging cells based on gibbon ape leukemia virus", J Virol. 65(5):2220-24
28. Miller (1992) "Human gene therapy comes of age", Nature 357:455-60
29. Mitani and Caskey (1993) "Delivering therapeutic genes—matching approach and application", Trends in Biotechnology 11(5):162-66
30. Nabel and Felgner (1993) "Direct gene transfer for immunotherapy and immunization", Trends in Biotechnology 11(5):211-15
31. Remy et al. (1994) "Gene Transfer with a Series of Lipphilic DNA-Binding Molecules", Bioconjugate Chem. 5(6):647-54
32. Sentmanat et al. (2018) "A Survey of Validation Strategies for CRISPR-Cas9 Editing", Scientific Reports 8:888, doi:10.1038/s41598-018-19441-8
33. Sommerfelt et al. (1990) "Localization of the receptor gene for type D simian retroviruses on human chromosome 19", J. Virol. 64(12):6214-20
34. Van Brunt (1988) "Molecular framing: transgenic animals as bioactors" Biotechnology 6:1149-54
35. Vigne et al. (1995) "Third-generation adenovectors for gene therapy", Restorative Neurology and Neuroscience 8(1,2): 35-36
36. Wilson et al. (1989) "Formation of infectious hybrid virion with gibbon ape leukemia virus and human T-cell leukemia virus retroviral envelope glycoproteins and the gag and pol proteins of Moloney murine leukemia virus", J. Virol. 63:2374-78
37. Yu et al. (1994) "Progress towards gene therapy for HIV infection", Gene Ther. 1(1):13-26
38. Zetsche et al. (2015) "Cpf1 is a single RNA-guided endonuclease of a class 2 CRIPSR-Cas system" Cell 163(3):759-71
39. Zuris et al. (2015) "Cationic lipid-mediated delivery of proteins enables efficient protein based genome editing in vitro and in vivo" Nat Biotechnol. 33(1):73-80

SEQUENCE LISTING (3015 sequences)

SEQ ID NO: 1 - RNA, 20 nt, Artificial Sequence
  synthesized
aggcuccacugagaggaagg

SEQ ID NO: 2 - RNA, 20 nt, Artificial Sequence
  synthesized
aggcucuacugagaggaagg

SEQ ID NO: 3 - RNA, 20 nt, Artificial Sequence
  synthesized
cacugagaggaaggacacgc

SEQ ID NO: 4 - RNA, 20 nt, Artificial Sequence
  synthesized
ccaaggcuccacugagagga

SEQ ID NO: 5 - RNA, 20 nt, Artificial Sequence
  synthesized
ccaaggcucuacugagagga

SEQ ID NO: 6 - RNA, 20 nt, Artificial Sequence
  synthesized
cccaaggcuccacugagagg

SEQ ID NO: 7 - RNA, 20 nt, Artificial Sequence
  synthesized
cccaaggcucuacugagagg

SEQ ID NO: 8 - RNA, 20 nt, Artificial Sequence
  synthesized
ccuuccucucaguagagccu

SEQ ID NO: 9 - RNA, 20 nt, Artificial Sequence
  synthesized
ccuuccucucaguggagccu

SEQ ID NO: 10 - RNA, 20 nt, Artificial Sequence
  synthesized
cucucaguagagccuugggg

SEQ ID NO: 11 - RNA, 20 nt, Artificial Sequence
  synthesized
cucucaguggagccuugggg

SEQ ID NO: 12 - RNA, 20 nt, Artificial Sequence
  synthesized
cuuccucucaguagagccuu

SEQ ID NO: 13 - RNA, 20 nt, Artificial Sequence
  synthesized
cuuccucucaguggagccuu

SEQ ID NO: 14 - RNA, 20 nt, Artificial Sequence
  synthesized
gccccaaggcuccacugaga

SEQ ID NO: 15 - RNA, 20 nt, Artificial Sequence
  synthesized
gccccaaggcucuacugaga

SEQ ID NO: 16 - RNA, 20 nt, Artificial Sequence
  synthesized
gcucggccccaaggcuccac

SEQ ID NO: 17 - RNA, 20 nt, Artificial Sequence
  synthesized
gcucggccccaaggcucuac

SEQ ID NO: 18 - RNA, 20 nt, Artificial Sequence
  synthesized
ggccccaaggcuccacugag

SEQ ID NO: 19 - RNA, 20 nt, Artificial Sequence
  synthesized
ggccccaaggcucuacugag

SEQ ID NO: 20 - RNA, 20 nt, Artificial Sequence
  synthesized
uacugagaggaaggacacgc

SEQ ID NO: 21 - RNA, 20 nt, Artificial Sequence
  synthesized
ucggccccaaggcuccacug

SEQ ID NO: 22 - RNA, 20 nt, Artificial Sequence
  synthesized
ucggccccaaggcucuacug

SEQ ID NO: 23 - RNA, 20 nt, Artificial Sequence
  synthesized
ucucaguagagccuuggggc

SEQ ID NO: 24 - RNA, 20 nt, Artificial Sequence
  synthesized
ucucaguggagccuuggggc

SEQ ID NO: 25 - RNA, 20 nt, Artificial Sequence
  synthesized
uuccucucaguagagccuug

SEQ ID NO: 26 - RNA, 20 nt, Artificial Sequence
  synthesized
uuccucucaguggagccuug

SEQ ID NO: 27 - RNA, 20 nt, Artificial Sequence
  synthesized
acugaggauccuggcuucuc

SEQ ID NO: 28 - RNA, 20 nt, Artificial Sequence
  synthesized
acugaggguccuggcuucuc

SEQ ID NO: 29 - RNA, 20 nt, Artificial Sequence
  synthesized
agaagccaggacccucagug

SEQ ID NO: 30 - RNA, 20 nt, Artificial Sequence
  synthesized
agaagccaggauccucagug

SEQ ID NO: 31 - RNA, 20 nt, Artificial Sequence
  synthesized
agagaagccaggacccucag

SEQ ID NO: 32 - RNA, 20 nt, Artificial Sequence
  synthesized
agagaagccaggauccucag

SEQ ID NO: 33 - RNA, 20 nt, Artificial Sequence
  synthesized
agccaggacccucaguggga

SEQ ID NO: 34 - RNA, 20 nt, Artificial Sequence
  synthesized
agccaggauccucaguggga

SEQ ID NO: 35 - RNA, 20 nt, Artificial Sequence
  synthesized
caggacccucagugggauga

SEQ ID NO: 36 - RNA, 20 nt, Artificial Sequence
  synthesized
caggauccucagugggauga

SEQ ID NO: 37 - RNA, 20 nt, Artificial Sequence
  synthesized
ccaggacccucagugggaug

SEQ ID NO: 38 - RNA, 20 nt, Artificial Sequence
  synthesized
ccaggauccucagugggaug

SEQ ID NO: 39 - RNA, 20 nt, Artificial Sequence
  synthesized
ccucaucccacugaggaucc

SEQ ID NO: 40 - RNA, 20 nt, Artificial Sequence
  synthesized
ccucaucccacugagggucc

SEQ ID NO: 41 - RNA, 20 nt, Artificial Sequence
  synthesized
gagaagccaggacccucagu

SEQ ID NO: 42 - RNA, 20 nt, Artificial Sequence
  synthesized
gagaagccaggauccucagu

SEQ ID NO: 43 - RNA, 20 nt, Artificial Sequence
  synthesized
gcagagaagccaggacccuc

SEQ ID NO: 44 - RNA, 20 nt, Artificial Sequence
  synthesized
gcagagaagccaggauccuc

SEQ ID NO: 45 - RNA, 20 nt, Artificial Sequence
  synthesized
ugaggauccuggcuucucug

SEQ ID NO: 46 - RNA, 20 nt, Artificial Sequence
  synthesized
ugaggguccuggcuucucug

SEQ ID NO: 47 - RNA, 20 nt, Artificial Sequence
  synthesized
auuuaacuguaggacuucug

SEQ ID NO: 48 - RNA, 20 nt, Artificial Sequence
  synthesized
aaauuuaacugccggacuuc

SEQ ID NO: 49 - RNA, 20 nt, Artificial Sequence
  synthesized
aaguccggcaguuaaauuua

SEQ ID NO: 50 - RNA, 20 nt, Artificial Sequence
  synthesized
aauuuaacugccggacuucu

SEQ ID NO: 51 - RNA, 20 nt, Artificial Sequence
  synthesized
auuuaacugccggacuucug

SEQ ID NO: 52 - RNA, 20 nt, Artificial Sequence
  synthesized
gucaaauaaauuuaacugcc

SEQ ID NO: 53 - RNA, 20 nt, Artificial Sequence
  synthesized
guccggcaguuaaauuuauu

SEQ ID NO: 54 - RNA, 20 nt, Artificial Sequence
  synthesized
agagaaauuaggaagaucac

SEQ ID NO: 55 - RNA, 20 nt, Artificial Sequence
  synthesized
agagaaauuaggaaggucac

SEQ ID NO: 56 - RNA, 20 nt, Artificial Sequence
  synthesized
aggaagaucacuggcacccu

SEQ ID NO: 57 - RNA, 20 nt, Artificial Sequence
  synthesized
aggaaggucacuggcacccu

SEQ ID NO: 58 - RNA, 20 nt, Artificial Sequence
  synthesized
ccugggagccccccuccaag

SEQ ID NO: 59 - RNA, 20 nt, Artificial Sequence
  synthesized
ccugggagccccccuccgag

SEQ ID NO: 60 - RNA, 20 nt, Artificial Sequence
  synthesized
gcucggaggggggcucccag

SEQ ID NO: 61 - RNA, 20 nt, Artificial Sequence
  synthesized
gcuuggaggggggcucccag

SEQ ID NO: 62 - RNA, 20 nt, Artificial Sequence
  synthesized
ggagccccccuccaagccca

SEQ ID NO: 63 - RNA, 20 nt, Artificial Sequence
  synthesized
ggagccccccuccgagccca

SEQ ID NO: 64 - RNA, 20 nt, Artificial Sequence
  synthesized
ggcucggaggggggcuccca

SEQ ID NO: 65 - RNA, 20 nt, Artificial Sequence
  synthesized
ggcuggcugggcucggaggg

SEQ ID NO: 66 - RNA, 20 nt, Artificial Sequence
  synthesized
ggcuuggaggggggcuccca

SEQ ID NO: 67 - RNA, 20 nt, Artificial Sequence
  synthesized
gggcuuggaggggggcuccc

SEQ ID NO: 68 - RNA, 20 nt, Artificial Sequence
  synthesized
uggcuggcugggcucggagg

SEQ ID NO: 69 - RNA, 20 nt, Artificial Sequence
  synthesized
ugggcucggaggggggcucc

SEQ ID NO: 70 - RNA, 20 nt, Artificial Sequence
  synthesized
ugggcuuggaggggggcucc

SEQ ID NO: 71 - RNA, 20 nt, Artificial Sequence
  synthesized
gaagagaaauuaggaagauc

SEQ ID NO: 72 - RNA, 20 nt, Artificial Sequence
  synthesized
gaagagaaauuaggaagguc

SEQ ID NO: 73 - RNA, 20 nt, Artificial Sequence
  synthesized
aagaguggguccccccaacc

SEQ ID NO: 74 - RNA, 20 nt, Artificial Sequence
  synthesized
aagaguggguccccccaccc

SEQ ID NO: 75 - RNA, 20 nt, Artificial Sequence
  synthesized
aggaggcuguggagucuggg

SEQ ID NO: 76 - RNA, 20 nt, Artificial Sequence
  synthesized
aggaggcuguggagucuggu

SEQ ID NO: 77 - RNA, 20 nt, Artificial Sequence
  synthesized
aggcuguggagucugggugg

SEQ ID NO: 78 - RNA, 20 nt, Artificial Sequence
  synthesized
aggcuguggagucugguugg

SEQ ID NO: 79 - RNA, 20 nt, Artificial Sequence
  synthesized
aguggguccccccaaccaga

SEQ ID NO: 80 - RNA, 20 nt, Artificial Sequence
  synthesized
aguggguccccccacccaga

SEQ ID NO: 81 - RNA, 20 nt, Artificial Sequence
  synthesized
gaggcuguggagucugggug

SEQ ID NO: 82 - RNA, 20 nt, Artificial Sequence
  synthesized
gaggcuguggagucugguug

SEQ ID NO: 83 - RNA, 20 nt, Artificial Sequence
  synthesized
gcuguggagucugggugggg

SEQ ID NO: 84 - RNA, 20 nt, Artificial Sequence
  synthesized
gcuguggagucugguugggg

SEQ ID NO: 85 - RNA, 20 nt, Artificial Sequence
  synthesized
ggaggcuguggagucugguu

SEQ ID NO: 86 - RNA, 20 nt, Artificial Sequence
  synthesized
ggcuguggagucuggguggg

SEQ ID NO: 87 - RNA, 20 nt, Artificial Sequence
  synthesized
ggcuguggagucugguuggg

SEQ ID NO: 88 - RNA, 20 nt, Artificial Sequence
  synthesized
ggguccccccaaccagacuc

SEQ ID NO: 89 - RNA, 20 nt, Artificial Sequence
  synthesized
ggguccccccacccagacuc

SEQ ID NO: 90 - RNA, 20 nt, Artificial Sequence
  synthesized
ucuggguggggggacccacu

SEQ ID NO: 91 - RNA, 20 nt, Artificial Sequence
  synthesized
ucugguuggggggacccacu

SEQ ID NO: 92 - RNA, 20 nt, Artificial Sequence
  synthesized
uggguggggggacccacucu

SEQ ID NO: 93 - RNA, 20 nt, Artificial Sequence
  synthesized
ugguuggggggacccacucu

SEQ ID NO: 94 - RNA, 20 nt, Artificial Sequence
  synthesized
aauaaggcagccacucccaa

SEQ ID NO: 95 - RNA, 20 nt, Artificial Sequence
  synthesized
aauaaggcaggcacucccaa

SEQ ID NO: 96 - RNA, 20 nt, Artificial Sequence
  synthesized
agugccugccuuauuguaga

SEQ ID NO: 97 - RNA, 20 nt, Artificial Sequence
  synthesized
aguggcugccuuauuguaga

SEQ ID NO: 98 - RNA, 20 nt, Artificial Sequence
  synthesized
cuacaauaaggcagccacuc

SEQ ID NO: 99 - RNA, 20 nt, Artificial Sequence
  synthesized
cuacaauaaggcaggcacuc

SEQ ID NO: 100 - RNA, 20 nt, Artificial Sequence
  synthesized
gaguggcugccuuauuguag

SEQ ID NO: 101 - RNA, 20 nt, Artificial Sequence
  synthesized
gggagugccugccuuauugu

SEQ ID NO: 102 - RNA, 20 nt, Artificial Sequence
  synthesized
gggaguggcugccuuauugu

SEQ ID NO: 103 - RNA, 20 nt, Artificial Sequence
  synthesized
aaaacacagacuguuacauc

SEQ ID NO: 104 - RNA, 20 nt, Artificial Sequence
  synthesized
aaaacacagacuguuccauc

SEQ ID NO: 105 - RNA, 20 nt, Artificial Sequence
  synthesized
aacacagacuguuacaucug

SEQ ID NO: 106 - RNA, 20 nt, Artificial Sequence
  synthesized
aacacagacuguuccaucug

SEQ ID NO: 107 - RNA, 20 nt, Artificial Sequence
  synthesized
acuguuacaucugugugcag

SEQ ID NO: 108 - RNA, 20 nt, Artificial Sequence
  synthesized
acuguuccaucugugugcag

SEQ ID NO: 109 - RNA, 20 nt, Artificial Sequence
  synthesized
agacuguuacaucugugugc

SEQ ID NO: 110 - RNA, 20 nt, Artificial Sequence
  synthesized
agacuguuccaucugugugc

SEQ ID NO: 111 - RNA, 20 nt, Artificial Sequence
  synthesized
cuguuacaucugugugcaga

SEQ ID NO: 112 - RNA, 20 nt, Artificial Sequence
  synthesized
cuguuccaucugugugcaga

SEQ ID NO: 113 - RNA, 20 nt, Artificial Sequence
  synthesized
gauggaacagucuguguuuu

SEQ ID NO: 114 - RNA, 20 nt, Artificial Sequence
  synthesized
guuacaucugugugcagagg

SEQ ID NO: 115 - RNA, 20 nt, Artificial Sequence
  synthesized
guuccaucugugugcagagg

SEQ ID NO: 116 - RNA, 20 nt, Artificial Sequence
  synthesized
uccaucugugugcagagggg

SEQ ID NO: 117 - RNA, 20 nt, Artificial Sequence
  synthesized
uccccucugcacacagaugg

SEQ ID NO: 118 - RNA, 20 nt, Artificial Sequence
  synthesized
uccccucugcacacagaugu

SEQ ID NO: 119 - RNA, 20 nt, Artificial Sequence
  synthesized
ugcacacagauggaacaguc

SEQ ID NO: 120 - RNA, 20 nt, Artificial Sequence
  synthesized
ugcacacagauguaacaguc

SEQ ID NO: 121 - RNA, 20 nt, Artificial Sequence
  synthesized
uggaacagucuguguuuucc

SEQ ID NO: 122 - RNA, 20 nt, Artificial Sequence
  synthesized
uguaacagucuguguuuucc

SEQ ID NO: 123 - RNA, 20 nt, Artificial Sequence
  synthesized
uguuacaucugugugcagag

SEQ ID NO: 124 - RNA, 20 nt, Artificial Sequence
  synthesized
uguuccaucugugugcagag

SEQ ID NO: 125 - RNA, 20 nt, Artificial Sequence
  synthesized
aggggcagcaugcauggccg

SEQ ID NO: 126 - RNA, 20 nt, Artificial Sequence
  synthesized
aggggcagcauguauggccg

SEQ ID NO: 127 - RNA, 20 nt, Artificial Sequence
  synthesized
augcauggccgugaagacca

SEQ ID NO: 128 - RNA, 20 nt, Artificial Sequence
  synthesized
auguauggccgugaagacca

SEQ ID NO: 129 - RNA, 20 nt, Artificial Sequence
  synthesized
caugcauggccgugaagacc

SEQ ID NO: 130 - RNA, 20 nt, Artificial Sequence
  synthesized
cauguauggccgugaagacc

SEQ ID NO: 131 - RNA, 20 nt, Artificial Sequence
  synthesized
gaaggcaggggcagcaugca

SEQ ID NO: 132 - RNA, 20 nt, Artificial Sequence
  synthesized
gaaggcaggggcagcaugua

SEQ ID NO: 133 - RNA, 20 nt, Artificial Sequence
  synthesized
gcaggggcagcaugcauggc

SEQ ID NO: 134 - RNA, 20 nt, Artificial Sequence
  synthesized
gcaggggcagcauguauggc

SEQ ID NO: 135 - RNA, 20 nt, Artificial Sequence
  synthesized
gcauggccgugaagaccacg

SEQ ID NO: 136 - RNA, 20 nt, Artificial Sequence
  synthesized
ggcagcaugcauggccguga

SEQ ID NO: 137 - RNA, 20 nt, Artificial Sequence
  synthesized
ggcagcauguauggccguga

SEQ ID NO: 138 - RNA, 20 nt, Artificial Sequence
  synthesized
ggggcagcaugcauggccgu

SEQ ID NO: 139 - RNA, 20 nt, Artificial Sequence
  synthesized
ggggcagcauguauggccgu

SEQ ID NO: 140 - RNA, 20 nt, Artificial Sequence
  synthesized
ugcauggccgugaagaccac

SEQ ID NO: 141 - RNA, 20 nt, Artificial Sequence
  synthesized
uguauggccgugaagaccac

SEQ ID NO: 142 - RNA, 20 nt, Artificial Sequence
  synthesized
agggaacaacagcccuuccu

SEQ ID NO: 143 - RNA, 20 nt, Artificial Sequence
  synthesized
aggggacaacagcccuuccu

SEQ ID NO: 144 - RNA, 20 nt, Artificial Sequence
  synthesized
aggugggggucucagggaac

SEQ ID NO: 145 - RNA, 20 nt, Artificial Sequence
  synthesized
aggugggggucucaggggac

SEQ ID NO: 146 - RNA, 20 nt, Artificial Sequence
  synthesized
gaggaagggcuguugucccc

SEQ ID NO: 147 - RNA, 20 nt, Artificial Sequence
  synthesized
gaggaagggcuguuguuccc

SEQ ID NO: 148 - RNA, 20 nt, Artificial Sequence
  synthesized
ggaagggcuguuguucccug

SEQ ID NO: 149 - RNA, 20 nt, Artificial Sequence
  synthesized
gggcuguuguccccugagac

SEQ ID NO: 150 - RNA, 20 nt, Artificial Sequence
  synthesized
gggcuguuguucccugagac

SEQ ID NO: 151 - RNA, 20 nt, Artificial Sequence
  synthesized
guuguccccugagaccccca

SEQ ID NO: 152 - RNA, 20 nt, Artificial Sequence
  synthesized
guuguucccugagaccccca

SEQ ID NO: 153 - RNA, 20 nt, Artificial Sequence
  synthesized
agggguuggcugcuuaugua

SEQ ID NO: 154 - RNA, 20 nt, Artificial Sequence
  synthesized
cuuacauaagcagccaaccc

SEQ ID NO: 155 - RNA, 20 nt, Artificial Sequence
  synthesized
uaagcagccaaccccugggc

SEQ ID NO: 156 - RNA, 20 nt, Artificial Sequence
  synthesized
uaagcggccaaccccugggc

SEQ ID NO: 157 - RNA, 20 nt, Artificial Sequence
  synthesized
uacauaagcagccaaccccu

SEQ ID NO: 158 - RNA, 20 nt, Artificial Sequence
  synthesized
uuacauaagcagccaacccc

SEQ ID NO: 159 - RNA, 20 nt, Artificial Sequence
  synthesized
auaaagugaagaucgcgcag

SEQ ID NO: 160 - RNA, 20 nt, Artificial Sequence
  synthesized
gauaaagugaagaucgcgca

SEQ ID NO: 161 - RNA, 20 nt, Artificial Sequence
  synthesized
ggauaaagugaagaucgcgc

SEQ ID NO: 162 - RNA, 20 nt, Artificial Sequence
  synthesized
agaagccaguaaaauuaugg

SEQ ID NO: 163 - RNA, 20 nt, Artificial Sequence
  synthesized
agaagccagugaaauuaugg

SEQ ID NO: 164 - RNA, 20 nt, Artificial Sequence
  synthesized
auagaagccagugaaauuau

SEQ ID NO: 165 - RNA, 20 nt, Artificial Sequence
  synthesized
ccagugaaauuauggagauu

SEQ ID NO: 166 - RNA, 20 nt, Artificial Sequence
  synthesized
gauagaagccaguaaaauua

SEQ ID NO: 167 - RNA, 20 nt, Artificial Sequence
  synthesized
gauagaagccagugaaauua

SEQ ID NO: 168 - RNA, 20 nt, Artificial Sequence
  synthesized
ucaaaucuccauaauuucac

SEQ ID NO: 169 - RNA, 20 nt, Artificial Sequence
  synthesized
aaaacuucccaaucuugaug

SEQ ID NO: 170 - RNA, 20 nt, Artificial Sequence
  synthesized
aaaacuucucaaucuugaug

SEQ ID NO: 171 - RNA, 20 nt, Artificial Sequence
  synthesized
aaacuucccaaucuugaugg

SEQ ID NO: 172 - RNA, 20 nt, Artificial Sequence
  synthesized
aaacuucucaaucuugaugg

SEQ ID NO: 173 - RNA, 20 nt, Artificial Sequence
  synthesized
acuucccaaucuugaugggg

SEQ ID NO: 174 - RNA, 20 nt, Artificial Sequence
  synthesized
acuucucaaucuugaugggg

SEQ ID NO: 175 - RNA, 20 nt, Artificial Sequence
  synthesized
agauugagaaguuuucaaag

SEQ ID NO: 176 - RNA, 20 nt, Artificial Sequence
  synthesized
agauugggaaguuuucaaag

SEQ ID NO: 177 - RNA, 20 nt, Artificial Sequence
  synthesized
aucaagauugagaaguuuuc

SEQ ID NO: 178 - RNA, 20 nt, Artificial Sequence
  synthesized
aucaagauugggaaguuuuc

SEQ ID NO: 179 - RNA, 20 nt, Artificial Sequence
  synthesized
auugagaaguuuucaaaggc

SEQ ID NO: 180 - RNA, 20 nt, Artificial Sequence
  synthesized
auugggaaguuuucaaaggc

SEQ ID NO: 181 - RNA, 20 nt, Artificial Sequence
  synthesized
caagauugagaaguuuucaa

SEQ ID NO: 182 - RNA, 20 nt, Artificial Sequence
  synthesized
caagauugggaaguuuucaa

SEQ ID NO: 183 - RNA, 20 nt, Artificial Sequence
  synthesized
cuuugaaaacuucccaaucu

SEQ ID NO: 184 - RNA, 20 nt, Artificial Sequence
  synthesized
cuuugaaaacuucucaaucu

SEQ ID NO: 185 - RNA, 20 nt, Artificial Sequence
  synthesized
gaaaacuucucaaucuugau

SEQ ID NO: 186 - RNA, 20 nt, Artificial Sequence
  synthesized
ugaaaacuucucaaucuuga

SEQ ID NO: 187 - RNA, 20 nt, Artificial Sequence
  synthesized
cugucaucuuucuuuccaag

SEQ ID NO: 188 - RNA, 20 nt, Artificial Sequence
  synthesized
gaaagaaaaaugacagacac

SEQ ID NO: 189 - RNA, 20 nt, Artificial Sequence
  synthesized
ggaaagaaaaaugacagaca

SEQ ID NO: 190 - RNA, 20 nt, Artificial Sequence
  synthesized
ggaaagaaagaugacagaca

SEQ ID NO: 191 - RNA, 20 nt, Artificial Sequence
  synthesized
gucaucuuucuuuccaagua

SEQ ID NO: 192 - RNA, 20 nt, Artificial Sequence
  synthesized
gucauuuuucuuuccaagua

SEQ ID NO: 193 - RNA, 20 nt, Artificial Sequence
  synthesized
guucuacuuggaaagaaaaa

SEQ ID NO: 194 - RNA, 20 nt, Artificial Sequence
  synthesized
guucuacuuggaaagaaaga

SEQ ID NO: 195 - RNA, 20 nt, Artificial Sequence
  synthesized
uacuuggaaagaaaaaugac

SEQ ID NO: 196 - RNA, 20 nt, Artificial Sequence
  synthesized
ucuacuuggaaagaaagaug

SEQ ID NO: 197 - RNA, 20 nt, Artificial Sequence
  synthesized
ugucaucuuucuuuccaagu

SEQ ID NO: 198 - RNA, 20 nt, Artificial Sequence
  synthesized
ugugucugucaucuuucuuu

SEQ ID NO: 199 - RNA, 20 nt, Artificial Sequence
  synthesized
ugugucugucauuuuucuuu

SEQ ID NO: 200 - RNA, 20 nt, Artificial Sequence
  synthesized
aaagacagcgaaaggucuac

SEQ ID NO: 201 - RNA, 20 nt, Artificial Sequence
  synthesized
aaagacagcgaaaggucugc

SEQ ID NO: 202 - RNA, 20 nt, Artificial Sequence
  synthesized
aagacagcgaaaggucuacu

SEQ ID NO: 203 - RNA, 20 nt, Artificial Sequence
  synthesized
aagacagcgaaaggucugcu

SEQ ID NO: 204 - RNA, 20 nt, Artificial Sequence
  synthesized
aaggucuacugggguaccau

SEQ ID NO: 205 - RNA, 20 nt, Artificial Sequence
  synthesized
aaggucugcugggguaccau

SEQ ID NO: 206 - RNA, 20 nt, Artificial Sequence
  synthesized
acugggguaccaucaaggua

SEQ ID NO: 207 - RNA, 20 nt, Artificial Sequence
  synthesized
agacagcgaaaggucuacug

SEQ ID NO: 208 - RNA, 20 nt, Artificial Sequence
  synthesized
agacagcgaaaggucugcug

SEQ ID NO: 209 - RNA, 20 nt, Artificial Sequence
  synthesized
agcagaccuuucgcugucuu

SEQ ID NO: 210 - RNA, 20 nt, Artificial Sequence
  synthesized
aguagaccuuucgcugucuu

SEQ ID NO: 211 - RNA, 20 nt, Artificial Sequence
  synthesized
cagcgaaaggucuacugggg

SEQ ID NO: 212 - RNA, 20 nt, Artificial Sequence
  synthesized
cagcgaaaggucugcugggg

SEQ ID NO: 213 - RNA, 20 nt, Artificial Sequence
  synthesized
gcugggguaccaucaaggua

SEQ ID NO: 214 - RNA, 20 nt, Artificial Sequence
  synthesized
ggucuacugggguaccauca

SEQ ID NO: 215 - RNA, 20 nt, Artificial Sequence
  synthesized
ggucugcugggguaccauca

SEQ ID NO: 216 - RNA, 20 nt, Artificial Sequence
  synthesized
gucuacugggguaccaucaa

SEQ ID NO: 217 - RNA, 20 nt, Artificial Sequence
  synthesized
gucugcugggguaccaucaa

SEQ ID NO: 218 - RNA, 20 nt, Artificial Sequence
  synthesized
uaccuugaugguaccccagc

SEQ ID NO: 219 - RNA, 20 nt, Artificial Sequence
  synthesized
uaccuugaugguaccccagu

SEQ ID NO: 220 - RNA, 20 nt, Artificial Sequence
  synthesized
agaguguuaacgggaaauca

SEQ ID NO: 221 - RNA, 20 nt, Artificial Sequence
  synthesized
ugauuucccauuaacacucu

SEQ ID NO: 222 - RNA, 20 nt, Artificial Sequence
  synthesized
ugauuucccguuaacacucu

SEQ ID NO: 223 - RNA, 20 nt, Artificial Sequence
  synthesized
acuaggcaccuacuugucuc

SEQ ID NO: 224 - RNA, 20 nt, Artificial Sequence
  synthesized
augaauauuuguuaaguggg

SEQ ID NO: 225 - RNA, 20 nt, Artificial Sequence
  synthesized
auuaggcaccuacuugucuc

SEQ ID NO: 226 - RNA, 20 nt, Artificial Sequence
  synthesized
ucacuaggcaccuacuuguc

SEQ ID NO: 227 - RNA, 20 nt, Artificial Sequence
  synthesized
ucauuaggcaccuacuuguc

SEQ ID NO: 228 - RNA, 20 nt, Artificial Sequence
  synthesized
ugagacaaguaggugccuaa

SEQ ID NO: 229 - RNA, 20 nt, Artificial Sequence
  synthesized
ugagacaaguaggugccuag

SEQ ID NO: 230 - RNA, 20 nt, Artificial Sequence
  synthesized
cccucucggcugagggacug

SEQ ID NO: 231 - RNA, 20 nt, Artificial Sequence
  synthesized
gaggggcugucacucucggc

SEQ ID NO: 232 - RNA, 20 nt, Artificial Sequence
  synthesized
gaggggcugucccucucggc

SEQ ID NO: 233 - RNA, 20 nt, Artificial Sequence
  synthesized
gccgagagggacagccccuc

SEQ ID NO: 234 - RNA, 20 nt, Artificial Sequence
  synthesized
gccgagagugacagccccuc

SEQ ID NO: 235 - RNA, 20 nt, Artificial Sequence
  synthesized
ggcugucacucucggcugag

SEQ ID NO: 236 - RNA, 20 nt, Artificial Sequence
  synthesized
ggcugucccucucggcugag

SEQ ID NO: 237 - RNA, 20 nt, Artificial Sequence
  synthesized
gggcugucacucucggcuga

SEQ ID NO: 238 - RNA, 20 nt, Artificial Sequence
  synthesized
gggcugucccucucggcuga

SEQ ID NO: 239 - RNA, 20 nt, Artificial Sequence
  synthesized
ggggcugucacucucggcug

SEQ ID NO: 240 - RNA, 20 nt, Artificial Sequence
  synthesized
ggggcugucccucucggcug

SEQ ID NO: 241 - RNA, 20 nt, Artificial Sequence
  synthesized
gucacucucggcugagggac

SEQ ID NO: 242 - RNA, 20 nt, Artificial Sequence
  synthesized
gucagaggggcugucacucu

SEQ ID NO: 243 - RNA, 20 nt, Artificial Sequence
  synthesized
gucagaggggcugucccucu

SEQ ID NO: 244 - RNA, 20 nt, Artificial Sequence
  synthesized
gucccucucggcugagggac

SEQ ID NO: 245 - RNA, 20 nt, Artificial Sequence
  synthesized
ucagucccucagccgagagg

SEQ ID NO: 246 - RNA, 20 nt, Artificial Sequence
  synthesized
ucagucccucagccgagagu

SEQ ID NO: 247 - RNA, 20 nt, Artificial Sequence
  synthesized
agcuccucuguggggcagcu

SEQ ID NO: 248 - RNA, 20 nt, Artificial Sequence
  synthesized
auucccagaagcagcuccuc

SEQ ID NO: 249 - RNA, 20 nt, Artificial Sequence
  synthesized
auucccagaagcagcugcuc

SEQ ID NO: 250 - RNA, 20 nt, Artificial Sequence
  synthesized
agcccggucgagucccgagg

SEQ ID NO: 251 - RNA, 20 nt, Artificial Sequence
  synthesized
agcgcagcccggucgagucc

SEQ ID NO: 252 - RNA, 20 nt, Artificial Sequence
  synthesized
agcgccgcccggucgagucc

SEQ ID NO: 253 - RNA, 20 nt, Artificial Sequence
  synthesized
cgaccgggcggcgcucacug

SEQ ID NO: 254 - RNA, 20 nt, Artificial Sequence
  synthesized
cgaccgggcugcgcucacug

SEQ ID NO: 255 - RNA, 20 nt, Artificial Sequence
  synthesized
cgcagcccggucgagucccg

SEQ ID NO: 256 - RNA, 20 nt, Artificial Sequence
  synthesized
cgcccggucgagucccgagg

SEQ ID NO: 257 - RNA, 20 nt, Artificial Sequence
  synthesized
cggcgcucacugcccagccg

SEQ ID NO: 258 - RNA, 20 nt, Artificial Sequence
  synthesized
cggcugggcagugagcgcag

SEQ ID NO: 259 - RNA, 20 nt, Artificial Sequence
  synthesized
cggcugggcagugagcgccg

SEQ ID NO: 260 - RNA, 20 nt, Artificial Sequence
  synthesized
cugcgcucacugcccagccg

SEQ ID NO: 261 - RNA, 20 nt, Artificial Sequence
  synthesized
gcagcccggucgagucccga

SEQ ID NO: 262 - RNA, 20 nt, Artificial Sequence
  synthesized
gccgcccggucgagucccga

SEQ ID NO: 263 - RNA, 20 nt, Artificial Sequence
  synthesized
gcggcgcucacugcccagcc

SEQ ID NO: 264 - RNA, 20 nt, Artificial Sequence
  synthesized
gcugcgcucacugcccagcc

SEQ ID NO: 265 - RNA, 20 nt, Artificial Sequence
  synthesized
gcugggcagugagcgcagcc

SEQ ID NO: 266 - RNA, 20 nt, Artificial Sequence
  synthesized
gcugggcagugagcgccgcc

SEQ ID NO: 267 - RNA, 20 nt, Artificial Sequence
  synthesized
ggcagugagcgcagcccggu

SEQ ID NO: 268 - RNA, 20 nt, Artificial Sequence
  synthesized
ggcagugagcgccgcccggu

SEQ ID NO: 269 - RNA, 20 nt, Artificial Sequence
  synthesized
ggcggcgcucacugcccagc

SEQ ID NO: 270 - RNA, 20 nt, Artificial Sequence
  synthesized
ggcugcgcucacugcccagc

SEQ ID NO: 271 - RNA, 20 nt, Artificial Sequence
  synthesized
gggcagugagcgcagcccgg

SEQ ID NO: 272 - RNA, 20 nt, Artificial Sequence
  synthesized
ccacagagcagcugcuucug

SEQ ID NO: 273 - RNA, 20 nt, Artificial Sequence
  synthesized
ccacagaggagcugcuucug

SEQ ID NO: 274 - RNA, 20 nt, Artificial Sequence
  synthesized
ccagaagcagcugcucugug

SEQ ID NO: 275 - RNA, 20 nt, Artificial Sequence
  synthesized
cccacagagcagcugcuucu

SEQ ID NO: 276 - RNA, 20 nt, Artificial Sequence
  synthesized
cccagaagcagcugcucugu

SEQ ID NO: 277 - RNA, 20 nt, Artificial Sequence
  synthesized
ccccacagagcagcugcuuc

SEQ ID NO: 278 - RNA, 20 nt, Artificial Sequence
  synthesized
cuccucuguggggcagcugu

SEQ ID NO: 279 - RNA, 20 nt, Artificial Sequence
  synthesized
cugcucuguggggcagcugu

SEQ ID NO: 280 - RNA, 20 nt, Artificial Sequence
  synthesized
gagcugcuucugggaauccu

SEQ ID NO: 281 - RNA, 20 nt, Artificial Sequence
  synthesized
gcuccucuguggggcagcug

SEQ ID NO: 282 - RNA, 20 nt, Artificial Sequence
  synthesized
ucccagaagcagcugcucug

SEQ ID NO: 283 - RNA, 20 nt, Artificial Sequence
  synthesized
aacuggacacacuuacaccu

SEQ ID NO: 284 - RNA, 20 nt, Artificial Sequence
  synthesized
accaguccaacuggacacac

SEQ ID NO: 285 - RNA, 20 nt, Artificial Sequence
  synthesized
agguguaaguguguccaguu

SEQ ID NO: 286 - RNA, 20 nt, Artificial Sequence
  synthesized
gagguguaaguguguccagu

SEQ ID NO: 287 - RNA, 20 nt, Artificial Sequence
  synthesized
guaaguguguccaguuggac

SEQ ID NO: 288 - RNA, 20 nt, Artificial Sequence
  synthesized
guguaaguguguccaguugg

SEQ ID NO: 289 - RNA, 20 nt, Artificial Sequence
  synthesized
guguccaguuggacugguca

SEQ ID NO: 290 - RNA, 20 nt, Artificial Sequence
  synthesized
uggacacacuuacaccucuu

SEQ ID NO: 291 - RNA, 20 nt, Artificial Sequence
  synthesized
uguguccaguuggacugguc

SEQ ID NO: 292 - RNA, 20 nt, Artificial Sequence
  synthesized
caguggcccgaucucgcuuc

SEQ ID NO: 293 - RNA, 20 nt, Artificial Sequence
  synthesized
uggcccgaucucgcuucagu

SEQ ID NO: 294 - RNA, 20 nt, Artificial Sequence
  synthesized
aaagaccccuaccagcuggg

SEQ ID NO: 295 - RNA, 20 nt, Artificial Sequence
  synthesized
aaagacuccuaccagcuggg

SEQ ID NO: 296 - RNA, 20 nt, Artificial Sequence
  synthesized
agaccccuaccagcugggcg

SEQ ID NO: 297 - RNA, 20 nt, Artificial Sequence
  synthesized
agacuccuaccagcugggcg

SEQ ID NO: 298 - RNA, 20 nt, Artificial Sequence
  synthesized
gaaaagaccccuaccagcug

SEQ ID NO: 299 - RNA, 20 nt, Artificial Sequence
  synthesized
gaaaagacuccuaccagcug

SEQ ID NO: 300 - RNA, 20 nt, Artificial Sequence
  synthesized
gcccagcugguaggagucuu

SEQ ID NO: 301 - RNA, 20 nt, Artificial Sequence
  synthesized
gcccagcugguaggggucuu

SEQ ID NO: 302 - RNA, 20 nt, Artificial Sequence
  synthesized
ugaaaagaccccuaccagcu

SEQ ID NO: 303 - RNA, 20 nt, Artificial Sequence
  synthesized
ugaaaagacuccuaccagcu

SEQ ID NO: 304 - RNA, 20 nt, Artificial Sequence
  synthesized
uugaaaagaccccuaccagc

SEQ ID NO: 305 - RNA, 20 nt, Artificial Sequence
  synthesized
uugaaaagacuccuaccagc

SEQ ID NO: 306 - RNA, 20 nt, Artificial Sequence
  synthesized
accaaccugugggcagggag

SEQ ID NO: 307 - RNA, 20 nt, Artificial Sequence
  synthesized
accaacuugugggcagggag

SEQ ID NO: 308 - RNA, 20 nt, Artificial Sequence
  synthesized
accaauaccaaccugugggc

SEQ ID NO: 309 - RNA, 20 nt, Artificial Sequence
  synthesized
accaauaccaacuugugggc

SEQ ID NO: 310 - RNA, 20 nt, Artificial Sequence
  synthesized
aggggcaccaauaccaaccu

SEQ ID NO: 311 - RNA, 20 nt, Artificial Sequence
  synthesized
aggggcaccaauaccaacuu

SEQ ID NO: 312 - RNA, 20 nt, Artificial Sequence
  synthesized
auaccaaccugugggcaggg

SEQ ID NO: 313 - RNA, 20 nt, Artificial Sequence
  synthesized
auaccaacuugugggcaggg

SEQ ID NO: 314 - RNA, 20 nt, Artificial Sequence
  synthesized
caauaccaaccugugggcag

SEQ ID NO: 315 - RNA, 20 nt, Artificial Sequence
  synthesized
caauaccaacuugugggcag

SEQ ID NO: 316 - RNA, 20 nt, Artificial Sequence
  synthesized
ccaauaccaaccugugggca

SEQ ID NO: 317 - RNA, 20 nt, Artificial Sequence
  synthesized
ccaauaccaacuugugggca

SEQ ID NO: 318 - RNA, 20 nt, Artificial Sequence
  synthesized
cccugcccacaaguugguau

SEQ ID NO: 319 - RNA, 20 nt, Artificial Sequence
  synthesized
cccugcccacagguugguau

SEQ ID NO: 320 - RNA, 20 nt, Artificial Sequence
  synthesized
ccugcccacaaguugguauu

SEQ ID NO: 321 - RNA, 20 nt, Artificial Sequence
  synthesized
ccugcccacagguugguauu

SEQ ID NO: 322 - RNA, 20 nt, Artificial Sequence
  synthesized
gaggggcaccaauaccaacc

SEQ ID NO: 323 - RNA, 20 nt, Artificial Sequence
  synthesized
gaggggcaccaauaccaacu

SEQ ID NO: 324 - RNA, 20 nt, Artificial Sequence
  synthesized
gggcaccaauaccaaccugu

SEQ ID NO: 325 - RNA, 20 nt, Artificial Sequence
  synthesized
gggcaccaauaccaacuugu

SEQ ID NO: 326 - RNA, 20 nt, Artificial Sequence
  synthesized
ggggcaccaauaccaaccug

SEQ ID NO: 327 - RNA, 20 nt, Artificial Sequence
  synthesized
ggggcaccaauaccaacuug

SEQ ID NO: 328 - RNA, 20 nt, Artificial Sequence
  synthesized
gucccucccugcccacaagu

SEQ ID NO: 329 - RNA, 20 nt, Artificial Sequence
  synthesized
gucccucccugcccacaggu

SEQ ID NO: 330 - RNA, 20 nt, Artificial Sequence
  synthesized
gugucccucccugcccacaa

SEQ ID NO: 331 - RNA, 20 nt, Artificial Sequence
  synthesized
gugucccucccugcccacag

SEQ ID NO: 332 - RNA, 20 nt, Artificial Sequence
  synthesized
uaccaaccugugggcaggga

SEQ ID NO: 333 - RNA, 20 nt, Artificial Sequence
  synthesized
uaccaacuugugggcaggga

SEQ ID NO: 334 - RNA, 20 nt, Artificial Sequence
  synthesized
aaaaacccugccuggccggc

SEQ ID NO: 335 - RNA, 20 nt, Artificial Sequence
  synthesized
aaaaacccugccuggcuggc

SEQ ID NO: 336 - RNA, 20 nt, Artificial Sequence
  synthesized
aaaacccugccuggccggca

SEQ ID NO: 337 - RNA, 20 nt, Artificial Sequence
  synthesized
aaaacccugccuggcuggca

SEQ ID NO: 338 - RNA, 20 nt, Artificial Sequence
  synthesized
aaacccugccuggccggcaa

SEQ ID NO: 339 - RNA, 20 nt, Artificial Sequence
  synthesized
agauccuugccggccaggca

SEQ ID NO: 340 - RNA, 20 nt, Artificial Sequence
  synthesized
caaggagauccuugccagcc

SEQ ID NO: 341 - RNA, 20 nt, Artificial Sequence
  synthesized
caaggagauccuugccggcc

SEQ ID NO: 342 - RNA, 20 nt, Artificial Sequence
  synthesized
cggcaaggaucuccuugucc

SEQ ID NO: 343 - RNA, 20 nt, Artificial Sequence
  synthesized
gacaaggagauccuugccag

SEQ ID NO: 344 - RNA, 20 nt, Artificial Sequence
  synthesized
gacaaggagauccuugccgg

SEQ ID NO: 345 - RNA, 20 nt, Artificial Sequence
  synthesized
gagauccuugccggccaggc

SEQ ID NO: 346 - RNA, 20 nt, Artificial Sequence
  synthesized
uggcaaggaucuccuugucc

SEQ ID NO: 347 - RNA, 20 nt, Artificial Sequence
  synthesized
acuguuaucauugugaaagg

SEQ ID NO: 348 - RNA, 20 nt, Artificial Sequence
  synthesized
caaucaccuuucacaaugau

SEQ ID NO: 349 - RNA, 20 nt, Artificial Sequence
  synthesized
ccuuucacaaugauaacagu

SEQ ID NO: 350 - RNA, 20 nt, Artificial Sequence
  synthesized
cuacuguuaucauugugaaa

SEQ ID NO: 351 - RNA, 20 nt, Artificial Sequence
  synthesized
cuuucacaaugauaacagua

SEQ ID NO: 352 - RNA, 20 nt, Artificial Sequence
  synthesized
gguguucaaucaccuuucac

SEQ ID NO: 353 - RNA, 20 nt, Artificial Sequence
  synthesized
guuaucauugugaaagguga

SEQ ID NO: 354 - RNA, 20 nt, Artificial Sequence
  synthesized
guucaaucaccuuucacaau

SEQ ID NO: 355 - RNA, 20 nt, Artificial Sequence
  synthesized
uaucauugugaaaggugauu

SEQ ID NO: 356 - RNA, 20 nt, Artificial Sequence
  synthesized
uguucaaucaccuuucacaa

SEQ ID NO: 357 - RNA, 20 nt, Artificial Sequence
  synthesized
uuaucauugugaaaggugau

SEQ ID NO: 358 - RNA, 20 nt, Artificial Sequence
  synthesized
uugugaaaggugauugaaca

SEQ ID NO: 359 - RNA, 20 nt, Artificial Sequence
  synthesized
uugugaacggugauugaaca

SEQ ID NO: 360 - RNA, 20 nt, Artificial Sequence
  synthesized
acacuaggaugggccacggu

SEQ ID NO: 361 - RNA, 20 nt, Artificial Sequence
  synthesized
acacuagggugggccacggu

SEQ ID NO: 362 - RNA, 20 nt, Artificial Sequence
  synthesized
accaacacuaggaugggcca

SEQ ID NO: 363 - RNA, 20 nt, Artificial Sequence
  synthesized
accaacacuagggugggcca

SEQ ID NO: 364 - RNA, 20 nt, Artificial Sequence
  synthesized
accguggcccacccuagugu

SEQ ID NO: 365 - RNA, 20 nt, Artificial Sequence
  synthesized
accguggcccauccuagugu

SEQ ID NO: 366 - RNA, 20 nt, Artificial Sequence
  synthesized
ccaacacuaggaugggccac

SEQ ID NO: 367 - RNA, 20 nt, Artificial Sequence
  synthesized
ccaacacuagggugggccac

SEQ ID NO: 368 - RNA, 20 nt, Artificial Sequence
  synthesized
cuaccaacacuaggaugggc

SEQ ID NO: 369 - RNA, 20 nt, Artificial Sequence
  synthesized
cuaccaacacuagggugggc

SEQ ID NO: 370 - RNA, 20 nt, Artificial Sequence
  synthesized
cugugaccguggcccacccu

SEQ ID NO: 371 - RNA, 20 nt, Artificial Sequence
  synthesized
cugugaccguggcccauccu

SEQ ID NO: 372 - RNA, 20 nt, Artificial Sequence
  synthesized
gcagcuaccaacacuaggau

SEQ ID NO: 373 - RNA, 20 nt, Artificial Sequence
  synthesized
gcagcuaccaacacuagggu

SEQ ID NO: 374 - RNA, 20 nt, Artificial Sequence
  synthesized
ggcagcuaccaacacuagga

SEQ ID NO: 375 - RNA, 20 nt, Artificial Sequence
  synthesized
ggcagcuaccaacacuaggg

SEQ ID NO: 376 - RNA, 20 nt, Artificial Sequence
  synthesized
ugaccguggcccacccuagu

SEQ ID NO: 377 - RNA, 20 nt, Artificial Sequence
  synthesized
ugaccguggcccauccuagu

SEQ ID NO: 378 - RNA, 20 nt, Artificial Sequence
  synthesized
aggcgagggcuggaagcugg

SEQ ID NO: 379 - RNA, 20 nt, Artificial Sequence
  synthesized
aggugagggcuggaagcugg

SEQ ID NO: 380 - RNA, 20 nt, Artificial Sequence
  synthesized
cagcccucgccugcccaauc

SEQ ID NO: 381 - RNA, 20 nt, Artificial Sequence
  synthesized
cagcuuccagcccucaccug

SEQ ID NO: 382 - RNA, 20 nt, Artificial Sequence
  synthesized
cagcuuccagcccucgccug

SEQ ID NO: 383 - RNA, 20 nt, Artificial Sequence
  synthesized
caggcgagggcuggaagcug

SEQ ID NO: 384 - RNA, 20 nt, Artificial Sequence
  synthesized
caggugagggcuggaagcug

SEQ ID NO: 385 - RNA, 20 nt, Artificial Sequence
  synthesized
cgagggcuggaagcuggggg

SEQ ID NO: 386 - RNA, 20 nt, Artificial Sequence
  synthesized
gcaggcgagggcuggaagcu

SEQ ID NO: 387 - RNA, 20 nt, Artificial Sequence
  synthesized
gcaggugagggcuggaagcu

SEQ ID NO: 388 - RNA, 20 nt, Artificial Sequence
  synthesized
gcccucaccugcccaauccc

SEQ ID NO: 389 - RNA, 20 nt, Artificial Sequence
  synthesized
gcccucgccugcccaauccc

SEQ ID NO: 390 - RNA, 20 nt, Artificial Sequence
  synthesized
gcgagggcuggaagcugggg

SEQ ID NO: 391 - RNA, 20 nt, Artificial Sequence
  synthesized
gcuggggauugggcaggcga

SEQ ID NO: 392 - RNA, 20 nt, Artificial Sequence
  synthesized
gcuggggauugggcagguga

SEQ ID NO: 393 - RNA, 20 nt, Artificial Sequence
  synthesized
ggauugggcaggcgagggcu

SEQ ID NO: 394 - RNA, 20 nt, Artificial Sequence
  synthesized
ggcaggcgagggcuggaagc

SEQ ID NO: 395 - RNA, 20 nt, Artificial Sequence
  synthesized
ggcaggugagggcuggaagc

SEQ ID NO: 396 - RNA, 20 nt, Artificial Sequence
  synthesized
ggcgagggcuggaagcuggg

SEQ ID NO: 397 - RNA, 20 nt, Artificial Sequence
  synthesized
gggauugggcaggcgagggc

SEQ ID NO: 398 - RNA, 20 nt, Artificial Sequence
  synthesized
ggugagggcuggaagcuggg

SEQ ID NO: 399 - RNA, 20 nt, Artificial Sequence
  synthesized
gugagggcuggaagcugggg

SEQ ID NO: 400 - RNA, 20 nt, Artificial Sequence
  synthesized
ugagggcuggaagcuggggg

SEQ ID NO: 401 - RNA, 20 nt, Artificial Sequence
  synthesized
ugcuggggauugggcaggcg

SEQ ID NO: 402 - RNA, 20 nt, Artificial Sequence
  synthesized
ugcuggggauugggcaggug

SEQ ID NO: 403 - RNA, 20 nt, Artificial Sequence
  synthesized
aaagucugcacaaauaucuu

SEQ ID NO: 404 - RNA, 20 nt, Artificial Sequence
  synthesized
aaagucugcacaaaugucuu

SEQ ID NO: 405 - RNA, 20 nt, Artificial Sequence
  synthesized
aagucugcacaaauaucuug

SEQ ID NO: 406 - RNA, 20 nt, Artificial Sequence
  synthesized
aagucugcacaaaugucuug

SEQ ID NO: 407 - RNA, 20 nt, Artificial Sequence
  synthesized
aguccccaagacauuugugc

SEQ ID NO: 408 - RNA, 20 nt, Artificial Sequence
  synthesized
aguccccaagauauuugugc

SEQ ID NO: 409 - RNA, 20 nt, Artificial Sequence
  synthesized
agucugcacaaauaucuugg

SEQ ID NO: 410 - RNA, 20 nt, Artificial Sequence
  synthesized
agucugcacaaaugucuugg

SEQ ID NO: 411 - RNA, 20 nt, Artificial Sequence
  synthesized
aucccaguccccaagacauu

SEQ ID NO: 412 - RNA, 20 nt, Artificial Sequence
  synthesized
aucccaguccccaagauauu

SEQ ID NO: 413 - RNA, 20 nt, Artificial Sequence
  synthesized
caaagucugcacaaauaucu

SEQ ID NO: 414 - RNA, 20 nt, Artificial Sequence
  synthesized
caaagucugcacaaaugucu

SEQ ID NO: 415 - RNA, 20 nt, Artificial Sequence
  synthesized
cacaaauaucuuggggacug

SEQ ID NO: 416 - RNA, 20 nt, Artificial Sequence
  synthesized
cacaaaugucuuggggacug

SEQ ID NO: 417 - RNA, 20 nt, Artificial Sequence
  synthesized
gcacaaauaucuuggggacu

SEQ ID NO: 418 - RNA, 20 nt, Artificial Sequence
  synthesized
ugcacaaauaucuuggggac

SEQ ID NO: 419 - RNA, 20 nt, Artificial Sequence
  synthesized
ugcacaaaugucuuggggac

SEQ ID NO: 420 - RNA, 20 nt, Artificial Sequence
  synthesized
aagaccacggacagaagcuc

SEQ ID NO: 421 - RNA, 20 nt, Artificial Sequence
  synthesized
aagaccacggacagcagcuc

SEQ ID NO: 422 - RNA, 20 nt, Artificial Sequence
  synthesized
acagcagcucagauuugauu

SEQ ID NO: 423 - RNA, 20 nt, Artificial Sequence
  synthesized
aucaaaucugagcugcuguc

SEQ ID NO: 424 - RNA, 20 nt, Artificial Sequence
  synthesized
aucaaaucugagcuucuguc

SEQ ID NO: 425 - RNA, 20 nt, Artificial Sequence
  synthesized
caaaucugagcugcuguccg

SEQ ID NO: 426 - RNA, 20 nt, Artificial Sequence
  synthesized
caaaucugagcuucuguccg

SEQ ID NO: 427 - RNA, 20 nt, Artificial Sequence
  synthesized
cacggacagaagcucagauu

SEQ ID NO: 428 - RNA, 20 nt, Artificial Sequence
  synthesized
cacggacagcagcucagauu

SEQ ID NO: 429 - RNA, 20 nt, Artificial Sequence
  synthesized
cagcagcucagauuugauuc

SEQ ID NO: 430 - RNA, 20 nt, Artificial Sequence
  synthesized
cuucuguccguggucuucac

SEQ ID NO: 431 - RNA, 20 nt, Artificial Sequence
  synthesized
gaagcucagauuugauucgg

SEQ ID NO: 432 - RNA, 20 nt, Artificial Sequence
  synthesized
gaccacggacagaagcucag

SEQ ID NO: 433 - RNA, 20 nt, Artificial Sequence
  synthesized
gaccacggacagcagcucag

SEQ ID NO: 434 - RNA, 20 nt, Artificial Sequence
  synthesized
gagcugcuguccguggucuu

SEQ ID NO: 435 - RNA, 20 nt, Artificial Sequence
  synthesized
gagcuucuguccguggucuu

SEQ ID NO: 436 - RNA, 20 nt, Artificial Sequence
  synthesized
gcagcucagauuugauucgg

SEQ ID NO: 437 - RNA, 20 nt, Artificial Sequence
  synthesized
gcugcuguccguggucuuca

SEQ ID NO: 438 - RNA, 20 nt, Artificial Sequence
  synthesized
gcuucuguccguggucuuca

SEQ ID NO: 439 - RNA, 20 nt, Artificial Sequence
  synthesized
gugaagaccacggacagaag

SEQ ID NO: 440 - RNA, 20 nt, Artificial Sequence
  synthesized
gugaagaccacggacagcag

SEQ ID NO: 441 - RNA, 20 nt, Artificial Sequence
  synthesized
aggagguguggggcugccgg

SEQ ID NO: 442 - RNA, 20 nt, Artificial Sequence
  synthesized
cccgguacucuccccggcag

SEQ ID NO: 443 - RNA, 20 nt, Artificial Sequence
  synthesized
cggcagccccacaccuccua

SEQ ID NO: 444 - RNA, 20 nt, Artificial Sequence
  synthesized
cgguacucuccccggcagcc

SEQ ID NO: 445 - RNA, 20 nt, Artificial Sequence
  synthesized
cugccggggagaguaccggg

SEQ ID NO: 446 - RNA, 20 nt, Artificial Sequence
  synthesized
cugcgggggagaguaccggg

SEQ ID NO: 447 - RNA, 20 nt, Artificial Sequence
  synthesized
gagguguggggcugccgggg

SEQ ID NO: 448 - RNA, 20 nt, Artificial Sequence
  synthesized
gccggggagaguaccggguc

SEQ ID NO: 449 - RNA, 20 nt, Artificial Sequence
  synthesized
gcgggggagaguaccggguc

SEQ ID NO: 450 - RNA, 20 nt, Artificial Sequence
  synthesized
ggagguguggggcugccggg

SEQ ID NO: 451 - RNA, 20 nt, Artificial Sequence
  synthesized
gggcugccggggagaguacc

SEQ ID NO: 452 - RNA, 20 nt, Artificial Sequence
  synthesized
ggggcugccggggagaguac

SEQ ID NO: 453 - RNA, 20 nt, Artificial Sequence
  synthesized
guaggagguguggggcugcc

SEQ ID NO: 454 - RNA, 20 nt, Artificial Sequence
  synthesized
uaggagguguggggcugccg

SEQ ID NO: 455 - RNA, 20 nt, Artificial Sequence
  synthesized
uggggcugccggggagagua

SEQ ID NO: 456 - RNA, 20 nt, Artificial Sequence
  synthesized
acccacugaccacaagcagc

SEQ ID NO: 457 - RNA, 20 nt, Artificial Sequence
  synthesized
acccagugaccacaagcagc

SEQ ID NO: 458 - RNA, 20 nt, Artificial Sequence
  synthesized
acuggguccagucuaaaaug

SEQ ID NO: 459 - RNA, 20 nt, Artificial Sequence
  synthesized
cacuggguccagucuaaaau

SEQ ID NO: 460 - RNA, 20 nt, Artificial Sequence
  synthesized
caguggguccagucuaaaau

SEQ ID NO: 461 - RNA, 20 nt, Artificial Sequence
  synthesized
cauuuuagacuggacccacu

SEQ ID NO: 462 - RNA, 20 nt, Artificial Sequence
  synthesized
cauuuuagacuggacccagu

SEQ ID NO: 463 - RNA, 20 nt, Artificial Sequence
  synthesized
ccacugaccacaagcagccu

SEQ ID NO: 464 - RNA, 20 nt, Artificial Sequence
  synthesized
ccagugaccacaagcagccu

SEQ ID NO: 465 - RNA, 20 nt, Artificial Sequence
  synthesized
ccauuuuagacuggacccac

SEQ ID NO: 466 - RNA, 20 nt, Artificial Sequence
  synthesized
ccauuuuagacuggacccag

SEQ ID NO: 467 - RNA, 20 nt, Artificial Sequence
  synthesized
ccuaggcugcuuguggucac

SEQ ID NO: 468 - RNA, 20 nt, Artificial Sequence
  synthesized
ccuaggcugcuuguggucag

SEQ ID NO: 469 - RNA, 20 nt, Artificial Sequence
  synthesized
cuaggcugcuuguggucacu

SEQ ID NO: 470 - RNA, 20 nt, Artificial Sequence
  synthesized
cuaggcugcuuguggucagu

SEQ ID NO: 471 - RNA, 20 nt, Artificial Sequence
  synthesized
cuggguccagucuaaaaugg

SEQ ID NO: 472 - RNA, 20 nt, Artificial Sequence
  synthesized
gacuggacccacugaccaca

SEQ ID NO: 473 - RNA, 20 nt, Artificial Sequence
  synthesized
gacuggacccagugaccaca

SEQ ID NO: 474 - RNA, 20 nt, Artificial Sequence
  synthesized
ggcugcuuguggucaguggg

SEQ ID NO: 475 - RNA, 20 nt, Artificial Sequence
  synthesized
guggguccagucuaaaaugg

SEQ ID NO: 476 - RNA, 20 nt, Artificial Sequence
  synthesized
ucacuggguccagucuaaaa

SEQ ID NO: 477 - RNA, 20 nt, Artificial Sequence
  synthesized
ucaguggguccagucuaaaa

SEQ ID NO: 478 - RNA, 20 nt, Artificial Sequence
  synthesized
uuagacuggacccacugacc

SEQ ID NO: 479 - RNA, 20 nt, Artificial Sequence
  synthesized
uuagacuggacccagugacc

SEQ ID NO: 480 - RNA, 20 nt, Artificial Sequence
  synthesized
agagaggcccgaggggaggg

SEQ ID NO: 481 - RNA, 20 nt, Artificial Sequence
  synthesized
ccccucgggccucucccgag

SEQ ID NO: 482 - RNA, 20 nt, Artificial Sequence
  synthesized
ccccucgggccucucucgag

SEQ ID NO: 483 - RNA, 20 nt, Artificial Sequence
  synthesized
cccgagcagggcacaggagg

SEQ ID NO: 484 - RNA, 20 nt, Artificial Sequence
  synthesized
cccuccccucgggccucucc

SEQ ID NO: 485 - RNA, 20 nt, Artificial Sequence
  synthesized
ccuccugugcccugcucgag

SEQ ID NO: 486 - RNA, 20 nt, Artificial Sequence
  synthesized
ccuccugugcccugcucggg

SEQ ID NO: 487 - RNA, 20 nt, Artificial Sequence
  synthesized
ccucgggccucucccgagca

SEQ ID NO: 488 - RNA, 20 nt, Artificial Sequence
  synthesized
ccucgggccucucucgagca

SEQ ID NO: 489 - RNA, 20 nt, Artificial Sequence
  synthesized
ccucucccgagcagggcaca

SEQ ID NO: 490 - RNA, 20 nt, Artificial Sequence
  synthesized
ccucucucgagcagggcaca

SEQ ID NO: 491 - RNA, 20 nt, Artificial Sequence
  synthesized
ccugcucgagagaggcccga

SEQ ID NO: 492 - RNA, 20 nt, Artificial Sequence
  synthesized
ccugcucgggagaggcccga

SEQ ID NO: 493 - RNA, 20 nt, Artificial Sequence
  synthesized
cgagagaggcccgaggggag

SEQ ID NO: 494 - RNA, 20 nt, Artificial Sequence
  synthesized
cgggagaggcccgaggggag

SEQ ID NO: 495 - RNA, 20 nt, Artificial Sequence
  synthesized
cucccgagcagggcacagga

SEQ ID NO: 496 - RNA, 20 nt, Artificial Sequence
  synthesized
cucgagcagggcacaggagg

SEQ ID NO: 497 - RNA, 20 nt, Artificial Sequence
  synthesized
cucgggagaggcccgagggg

SEQ ID NO: 498 - RNA, 20 nt, Artificial Sequence
  synthesized
cucucgagcagggcacagga

SEQ ID NO: 499 - RNA, 20 nt, Artificial Sequence
  synthesized
cugcucgagagaggcccgag

SEQ ID NO: 500 - RNA, 20 nt, Artificial Sequence
  synthesized
cugcucgggagaggcccgag

SEQ ID NO: 501 - RNA, 20 nt, Artificial Sequence
  synthesized
gagagaggcccgaggggagg

SEQ ID NO: 502 - RNA, 20 nt, Artificial Sequence
  synthesized
gccucucccgagcagggcac

SEQ ID NO: 503 - RNA, 20 nt, Artificial Sequence
  synthesized
gccucucucgagcagggcac

SEQ ID NO: 504 - RNA, 20 nt, Artificial Sequence
  synthesized
gggagaggcccgaggggagg

SEQ ID NO: 505 - RNA, 20 nt, Artificial Sequence
  synthesized
uccugugcccugcucgagag

SEQ ID NO: 506 - RNA, 20 nt, Artificial Sequence
  synthesized
uccugugcccugcucgggag

SEQ ID NO: 507 - RNA, 20 nt, Artificial Sequence
  synthesized
ucgagagaggcccgagggga

SEQ ID NO: 508 - RNA, 20 nt, Artificial Sequence
  synthesized
ucgggagaggcccgagggga

SEQ ID NO: 509 - RNA, 20 nt, Artificial Sequence
  synthesized
ucucccgagcagggcacagg

SEQ ID NO: 510 - RNA, 20 nt, Artificial Sequence
  synthesized
ucucucgagcagggcacagg

SEQ ID NO: 511 - RNA, 20 nt, Artificial Sequence
  synthesized
ugcccugcucgagagaggcc

SEQ ID NO: 512 - RNA, 20 nt, Artificial Sequence
  synthesized
ugcccugcucgggagaggcc

SEQ ID NO: 513 - RNA, 20 nt, Artificial Sequence
  synthesized
ugcucgagagaggcccgagg

SEQ ID NO: 514 - RNA, 20 nt, Artificial Sequence
  synthesized
ugcucgggagaggcccgagg

SEQ ID NO: 515 - RNA, 20 nt, Artificial Sequence
  synthesized
acgaggcgcuccaggggacc

SEQ ID NO: 516 - RNA, 20 nt, Artificial Sequence
  synthesized
augaggcgcuccaggggacc

SEQ ID NO: 517 - RNA, 20 nt, Artificial Sequence
  synthesized
cccuggagcgccucauaccc

SEQ ID NO: 518 - RNA, 20 nt, Artificial Sequence
  synthesized
cccuggagcgccucguaccc

SEQ ID NO: 519 - RNA, 20 nt, Artificial Sequence
  synthesized
cggguacgaggcgcuccagg

SEQ ID NO: 520 - RNA, 20 nt, Artificial Sequence
  synthesized
cggguaugaggcgcuccagg

SEQ ID NO: 521 - RNA, 20 nt, Artificial Sequence
  synthesized
cugcggguacgaggcgcucc

SEQ ID NO: 522 - RNA, 20 nt, Artificial Sequence
  synthesized
cugcggguaugaggcgcucc

SEQ ID NO: 523 - RNA, 20 nt, Artificial Sequence
  synthesized
cuggagcgccucauacccgc

SEQ ID NO: 524 - RNA, 20 nt, Artificial Sequence
  synthesized
cuggagcgccucguacccgc

SEQ ID NO: 525 - RNA, 20 nt, Artificial Sequence
  synthesized
gccucauacccgcagaccgc

SEQ ID NO: 526 - RNA, 20 nt, Artificial Sequence
  synthesized
gccucguacccgcagaccgc

SEQ ID NO: 527 - RNA, 20 nt, Artificial Sequence
  synthesized
gcgccucauacccgcagacc

SEQ ID NO: 528 - RNA, 20 nt, Artificial Sequence
  synthesized
gcgccucguacccgcagacc

SEQ ID NO: 529 - RNA, 20 nt, Artificial Sequence
  synthesized
gcggguacgaggcgcuccag

SEQ ID NO: 530 - RNA, 20 nt, Artificial Sequence
  synthesized
gcggguaugaggcgcuccag

SEQ ID NO: 531 - RNA, 20 nt, Artificial Sequence
  synthesized
gguccccuggagcgccucau

SEQ ID NO: 532 - RNA, 20 nt, Artificial Sequence
  synthesized
guacgaggcgcuccagggga

SEQ ID NO: 533 - RNA, 20 nt, Artificial Sequence
  synthesized
guaugaggcgcuccagggga

SEQ ID NO: 534 - RNA, 20 nt, Artificial Sequence
  synthesized
gucugcggucugcggguacg

SEQ ID NO: 535 - RNA, 20 nt, Artificial Sequence
  synthesized
gucugcggucugcggguaug

SEQ ID NO: 536 - RNA, 20 nt, Artificial Sequence
  synthesized
ucugcggucugcggguacga

SEQ ID NO: 537 - RNA, 20 nt, Artificial Sequence
  synthesized
ucugcggucugcggguauga

SEQ ID NO: 538 - RNA, 20 nt, Artificial Sequence
  synthesized
ugcggguacgaggcgcucca

SEQ ID NO: 539 - RNA, 20 nt, Artificial Sequence
  synthesized
ugcggguaugaggcgcucca

SEQ ID NO: 540 - RNA, 20 nt, Artificial Sequence
  synthesized
uggagcgccucauacccgca

SEQ ID NO: 541 - RNA, 20 nt, Artificial Sequence
  synthesized
uggagcgccucguacccgca

SEQ ID NO: 542 - RNA, 20 nt, Artificial Sequence
  synthesized
uaauuugguuccuucugacu

SEQ ID NO: 543 - RNA, 20 nt, Artificial Sequence
  synthesized
cucaucagugagccgaauca

SEQ ID NO: 544 - RNA, 20 nt, Artificial Sequence
  synthesized
cucaucagugagccgacuca

SEQ ID NO: 545 - RNA, 20 nt, Artificial Sequence
  synthesized
gacucaaugaacaauuaaca

SEQ ID NO: 546 - RNA, 20 nt, Artificial Sequence
  synthesized
gagccgaaucaaugaacaau

SEQ ID NO: 547 - RNA, 20 nt, Artificial Sequence
  synthesized
gagccgacucaaugaacaau

SEQ ID NO: 548 - RNA, 20 nt, Artificial Sequence
  synthesized
gugagccgaaucaaugaaca

SEQ ID NO: 549 - RNA, 20 nt, Artificial Sequence
  synthesized
gugagccgacucaaugaaca

SEQ ID NO: 550 - RNA, 20 nt, Artificial Sequence
  synthesized
ucaucagugagccgaaucaa

SEQ ID NO: 551 - RNA, 20 nt, Artificial Sequence
  synthesized
ucaucagugagccgacucaa

SEQ ID NO: 552 - RNA, 20 nt, Artificial Sequence
  synthesized
ucauugagucggcucacuga

SEQ ID NO: 553 - RNA, 20 nt, Artificial Sequence
  synthesized
ucauugauucggcucacuga

SEQ ID NO: 554 - RNA, 20 nt, Artificial Sequence
  synthesized
uguucauugagucggcucac

SEQ ID NO: 555 - RNA, 20 nt, Artificial Sequence
  synthesized
uguucauugauucggcucac

SEQ ID NO: 556 - RNA, 20 nt, Artificial Sequence
  synthesized
uucauugagucggcucacug

SEQ ID NO: 557 - RNA, 20 nt, Artificial Sequence
  synthesized
uucauugauucggcucacug

SEQ ID NO: 558 - RNA, 20 nt, Artificial Sequence
  synthesized
acccagagcagguccuuuag

SEQ ID NO: 559 - RNA, 20 nt, Artificial Sequence
  synthesized
acccagcgcagguccuuuag

SEQ ID NO: 560 - RNA, 20 nt, Artificial Sequence
  synthesized
agcagguccuuuagugaccc

SEQ ID NO: 561 - RNA, 20 nt, Artificial Sequence
  synthesized
aggggacagugacccagagc

SEQ ID NO: 562 - RNA, 20 nt, Artificial Sequence
  synthesized
aggggacagugacccagcgc

SEQ ID NO: 563 - RNA, 20 nt, Artificial Sequence
  synthesized
cagagcagguccuuuaguga

SEQ ID NO: 564 - RNA, 20 nt, Artificial Sequence
  synthesized
cagcgcagguccuuuaguga

SEQ ID NO: 565 - RNA, 20 nt, Artificial Sequence
  synthesized
cgcagguccuuuagugaccc

SEQ ID NO: 566 - RNA, 20 nt, Artificial Sequence
  synthesized
gggucacuaaaggaccugcg

SEQ ID NO: 567 - RNA, 20 nt, Artificial Sequence
  synthesized
gggucacuaaaggaccugcu

SEQ ID NO: 568 - RNA, 20 nt, Artificial Sequence
  synthesized
ggucacuaaaggaccugcgc

SEQ ID NO: 569 - RNA, 20 nt, Artificial Sequence
  synthesized
ggucacuaaaggaccugcuc

SEQ ID NO: 570 - RNA, 20 nt, Artificial Sequence
  synthesized
guaggggacagugacccaga

SEQ ID NO: 571 - RNA, 20 nt, Artificial Sequence
  synthesized
guaggggacagugacccagc

SEQ ID NO: 572 - RNA, 20 nt, Artificial Sequence
  synthesized
gucacuaaaggaccugcgcu

SEQ ID NO: 573 - RNA, 20 nt, Artificial Sequence
  synthesized
gucacuaaaggaccugcucu

SEQ ID NO: 574 - RNA, 20 nt, Artificial Sequence
  synthesized
ugacccagagcagguccuuu

SEQ ID NO: 575 - RNA, 20 nt, Artificial Sequence
  synthesized
ugacccagcgcagguccuuu

SEQ ID NO: 576 - RNA, 20 nt, Artificial Sequence
  synthesized
ugcgcugggucacugucccc

SEQ ID NO: 577 - RNA, 20 nt, Artificial Sequence
  synthesized
ugcucugggucacugucccc

SEQ ID NO: 578 - RNA, 20 nt, Artificial Sequence
  synthesized
aauuagcggagucucuggaa

SEQ ID NO: 579 - RNA, 20 nt, Artificial Sequence
  synthesized
agagacuccgcuaauccacc

SEQ ID NO: 580 - RNA, 20 nt, Artificial Sequence
  synthesized
auuccacccucaacccccac

SEQ ID NO: 581 - RNA, 20 nt, Artificial Sequence
  synthesized
gauuagcggagucucuggaa

SEQ ID NO: 582 - RNA, 20 nt, Artificial Sequence
  synthesized
ggaauuagcggagucucugg

SEQ ID NO: 583 - RNA, 20 nt, Artificial Sequence
  synthesized
ggggguugaggguggauuag

SEQ ID NO: 584 - RNA, 20 nt, Artificial Sequence
  synthesized
gggguugaggguggauuagc

SEQ ID NO: 585 - RNA, 20 nt, Artificial Sequence
  synthesized
ggguggauuagcggagucuc

SEQ ID NO: 586 - RNA, 20 nt, Artificial Sequence
  synthesized
gguggauuagcggagucucu

SEQ ID NO: 587 - RNA, 20 nt, Artificial Sequence
  synthesized
guggggguugaggguggauu

SEQ ID NO: 588 - RNA, 20 nt, Artificial Sequence
  synthesized
ugagaguggggguugagggu

SEQ ID NO: 589 - RNA, 20 nt, Artificial Sequence
  synthesized
uggauuagcggagucucugg

SEQ ID NO: 590 - RNA, 20 nt, Artificial Sequence
  synthesized
aggcucccugcaugagccca

SEQ ID NO: 591 - RNA, 20 nt, Artificial Sequence
  synthesized
agggagcccgggccacaugg

SEQ ID NO: 592 - RNA, 20 nt, Artificial Sequence
  synthesized
auguggcccgggcucccugc

SEQ ID NO: 593 - RNA, 20 nt, Artificial Sequence
  synthesized
cagggagcccgggccacaug

SEQ ID NO: 594 - RNA, 20 nt, Artificial Sequence
  synthesized
cagggagccugggccacaug

SEQ ID NO: 595 - RNA, 20 nt, Artificial Sequence
  synthesized
cccgggccacaugggggacc

SEQ ID NO: 596 - RNA, 20 nt, Artificial Sequence
  synthesized
ccgggccacaugggggacca

SEQ ID NO: 597 - RNA, 20 nt, Artificial Sequence
  synthesized
ccugggccacaugggggacc

SEQ ID NO: 598 - RNA, 20 nt, Artificial Sequence
  synthesized
cgggccacaugggggaccag

SEQ ID NO: 599 - RNA, 20 nt, Artificial Sequence
  synthesized
cugggccacaugggggacca

SEQ ID NO: 600 - RNA, 20 nt, Artificial Sequence
  synthesized
gcagggagcccgggccacau

SEQ ID NO: 601 - RNA, 20 nt, Artificial Sequence
  synthesized
gcagggagccugggccacau

SEQ ID NO: 602 - RNA, 20 nt, Artificial Sequence
  synthesized
gggagcccgggccacauggg

SEQ ID NO: 603 - RNA, 20 nt, Artificial Sequence
  synthesized
gggagccugggccacauggg

SEQ ID NO: 604 - RNA, 20 nt, Artificial Sequence
  synthesized
gggcucaugcagggagcccg

SEQ ID NO: 605 - RNA, 20 nt, Artificial Sequence
  synthesized
gggcucccugcaugagccca

SEQ ID NO: 606 - RNA, 20 nt, Artificial Sequence
  synthesized
ugcagggagcccgggccaca

SEQ ID NO: 607 - RNA, 20 nt, Artificial Sequence
  synthesized
ugggccacaugggggaccag

SEQ ID NO: 608 - RNA, 20 nt, Artificial Sequence
  synthesized
ugggcucaugcagggagccc

SEQ ID NO: 609 - RNA, 20 nt, Artificial Sequence
  synthesized
ugggcucaugcagggagccu

SEQ ID NO: 610 - RNA, 20 nt, Artificial Sequence
  synthesized
uguggcccgggcucccugca

SEQ ID NO: 611 - RNA, 20 nt, Artificial Sequence
  synthesized
aacagcccuuccucggcuuc

SEQ ID NO: 612 - RNA, 20 nt, Artificial Sequence
  synthesized
aacagcccuuccucggcuuu

SEQ ID NO: 613 - RNA, 20 nt, Artificial Sequence
  synthesized
aaccagucggccuccaaagc

SEQ ID NO: 614 - RNA, 20 nt, Artificial Sequence
  synthesized
aaccagucggccuccgaagc

SEQ ID NO: 615 - RNA, 20 nt, Artificial Sequence
  synthesized
cagcccuuccucggcuucgg

SEQ ID NO: 616 - RNA, 20 nt, Artificial Sequence
  synthesized
cagcccuuccucggcuuugg

SEQ ID NO: 617 - RNA, 20 nt, Artificial Sequence
  synthesized
cagucggccuccaaagccga

SEQ ID NO: 618 - RNA, 20 nt, Artificial Sequence
  synthesized
cagucggccuccgaagccga

SEQ ID NO: 619 - RNA, 20 nt, Artificial Sequence
  synthesized
ccagucggccuccaaagccg

SEQ ID NO: 620 - RNA, 20 nt, Artificial Sequence
  synthesized
ccagucggccuccgaagccg

SEQ ID NO: 621 - RNA, 20 nt, Artificial Sequence
  synthesized
ccucggcuucggaggccgac

SEQ ID NO: 622 - RNA, 20 nt, Artificial Sequence
  synthesized
ccucggcuuuggaggccgac

SEQ ID NO: 623 - RNA, 20 nt, Artificial Sequence
  synthesized
ccuuccucggcuucggaggc

SEQ ID NO: 624 - RNA, 20 nt, Artificial Sequence
  synthesized
ccuuccucggcuuuggaggc

SEQ ID NO: 625 - RNA, 20 nt, Artificial Sequence
  synthesized
cggaggccgacugguugccu

SEQ ID NO: 626 - RNA, 20 nt, Artificial Sequence
  synthesized
cggccuccaaagccgaggaa

SEQ ID NO: 627 - RNA, 20 nt, Artificial Sequence
  synthesized
cggccuccgaagccgaggaa

SEQ ID NO: 628 - RNA, 20 nt, Artificial Sequence
  synthesized
ucggccuccaaagccgagga

SEQ ID NO: 629 - RNA, 20 nt, Artificial Sequence
  synthesized
ucggccuccgaagccgagga

SEQ ID NO: 630 - RNA, 20 nt, Artificial Sequence
  synthesized
uggaggccgacugguugccu

SEQ ID NO: 631 - RNA, 20 nt, Artificial Sequence
  synthesized
accccucacugggcugaguc

SEQ ID NO: 632 - RNA, 20 nt, Artificial Sequence
  synthesized
accccucccugggcugaguc

SEQ ID NO: 633 - RNA, 20 nt, Artificial Sequence
  synthesized
agcccagugagggguggccu

SEQ ID NO: 634 - RNA, 20 nt, Artificial Sequence
  synthesized
aucugacucagcccagggag

SEQ ID NO: 635 - RNA, 20 nt, Artificial Sequence
  synthesized
aucugacucagcccagugag

SEQ ID NO: 636 - RNA, 20 nt, Artificial Sequence
  synthesized
cagcccagugagggguggcc

SEQ ID NO: 637 - RNA, 20 nt, Artificial Sequence
  synthesized
caggccaccccucacugggc

SEQ ID NO: 638 - RNA, 20 nt, Artificial Sequence
  synthesized
caucugacucagcccaggga

SEQ ID NO: 639 - RNA, 20 nt, Artificial Sequence
  synthesized
caucugacucagcccaguga

SEQ ID NO: 640 - RNA, 20 nt, Artificial Sequence
  synthesized
ccaggccaccccucacuggg

SEQ ID NO: 641 - RNA, 20 nt, Artificial Sequence
  synthesized
ccaggccaccccucccuggg

SEQ ID NO: 642 - RNA, 20 nt, Artificial Sequence
  synthesized
ccagggagggguggccuggg

SEQ ID NO: 643 - RNA, 20 nt, Artificial Sequence
  synthesized
ccagugagggguggccuggg

SEQ ID NO: 644 - RNA, 20 nt, Artificial Sequence
  synthesized
ccaucugacucagcccaggg

SEQ ID NO: 645 - RNA, 20 nt, Artificial Sequence
  synthesized
ccaucugacucagcccagug

SEQ ID NO: 646 - RNA, 20 nt, Artificial Sequence
  synthesized
cccagggagggguggccugg

SEQ ID NO: 647 - RNA, 20 nt, Artificial Sequence
  synthesized
cccccaggccaccccucacu

SEQ ID NO: 648 - RNA, 20 nt, Artificial Sequence
  synthesized
cccccaggccaccccucccu

SEQ ID NO: 649 - RNA, 20 nt, Artificial Sequence
  synthesized
ccccucacugggcugaguca

SEQ ID NO: 650 - RNA, 20 nt, Artificial Sequence
  synthesized
ccccucccugggcugaguca

SEQ ID NO: 651 - RNA, 20 nt, Artificial Sequence
  synthesized
ccucacugggcugagucaga

SEQ ID NO: 652 - RNA, 20 nt, Artificial Sequence
  synthesized
ccucccugggcugagucaga

SEQ ID NO: 653 - RNA, 20 nt, Artificial Sequence
  synthesized
gcccagggagggguggccug

SEQ ID NO: 654 - RNA, 20 nt, Artificial Sequence
  synthesized
gcccagugagggguggccug

SEQ ID NO: 655 - RNA, 20 nt, Artificial Sequence
  synthesized
ucccccaggccaccccuccc

SEQ ID NO: 656 - RNA, 20 nt, Artificial Sequence
  synthesized
ucugacucagcccagugagg

SEQ ID NO: 657 - RNA, 20 nt, Artificial Sequence
  synthesized
aacccuuccccuauuaccgc

SEQ ID NO: 658 - RNA, 20 nt, Artificial Sequence
  synthesized
aucccuuccccuauuaccgc

SEQ ID NO: 659 - RNA, 20 nt, Artificial Sequence
  synthesized
cccacaaacccuuccccuau

SEQ ID NO: 660 - RNA, 20 nt, Artificial Sequence
  synthesized
aaugguucaccuggggacgg

SEQ ID NO: 661 - RNA, 20 nt, Artificial Sequence
  synthesized
augguucaccuggggacggu

SEQ ID NO: 662 - RNA, 20 nt, Artificial Sequence
  synthesized
gacucaccaccguccccagg

SEQ ID NO: 663 - RNA, 20 nt, Artificial Sequence
  synthesized
gguucaccuggggacggugg

SEQ ID NO: 664 - RNA, 20 nt, Artificial Sequence
  synthesized
ugacucaccaccguccccag

SEQ ID NO: 665 - RNA, 20 nt, Artificial Sequence
  synthesized
acugcagcugaggagaaggg

SEQ ID NO: 666 - RNA, 20 nt, Artificial Sequence
  synthesized
cgacuacagcugaggagaag

SEQ ID NO: 667 - RNA, 20 nt, Artificial Sequence
  synthesized
cgacugcagcugaggagaag

SEQ ID NO: 668 - RNA, 20 nt, Artificial Sequence
  synthesized
cuacagcugaggagaaggga

SEQ ID NO: 669 - RNA, 20 nt, Artificial Sequence
  synthesized
ucgacuacagcugaggagaa

SEQ ID NO: 670 - RNA, 20 nt, Artificial Sequence
  synthesized
ucgacugcagcugaggagaa

SEQ ID NO: 671 - RNA, 20 nt, Artificial Sequence
  synthesized
cccacaaucccuuccccuau

SEQ ID NO: 672 - RNA, 20 nt, Artificial Sequence
  synthesized
gcgguaauaggggaagggau

SEQ ID NO: 673 - RNA, 20 nt, Artificial Sequence
  synthesized
gcgguaauaggggaaggguu

SEQ ID NO: 674 - RNA, 20 nt, Artificial Sequence
  synthesized
gguaauaggggaagggauug

SEQ ID NO: 675 - RNA, 20 nt, Artificial Sequence
  synthesized
gguaauaggggaaggguuug

SEQ ID NO: 676 - RNA, 20 nt, Artificial Sequence
  synthesized
guaauaggggaagggauugu

SEQ ID NO: 677 - RNA, 20 nt, Artificial Sequence
  synthesized
guaauaggggaaggguuugu

SEQ ID NO: 678 - RNA, 20 nt, Artificial Sequence
  synthesized
guuuguggggccugccccuc

SEQ ID NO: 679 - RNA, 20 nt, Artificial Sequence
  synthesized
uaauaggggaagggauugug

SEQ ID NO: 680 - RNA, 20 nt, Artificial Sequence
  synthesized
uaauaggggaaggguuugug

SEQ ID NO: 681 - RNA, 20 nt, Artificial Sequence
  synthesized
cugcuucggauucauggccc

SEQ ID NO: 682 - RNA, 20 nt, Artificial Sequence
  synthesized
cugcuucugauucauggccc

SEQ ID NO: 683 - RNA, 20 nt, Artificial Sequence
  synthesized
gagggguacugcuucggauu

SEQ ID NO: 684 - RNA, 20 nt, Artificial Sequence
  synthesized
gagggguacugcuucugauu

SEQ ID NO: 685 - RNA, 20 nt, Artificial Sequence
  synthesized
gcacugggccaugaaucaga

SEQ ID NO: 686 - RNA, 20 nt, Artificial Sequence
  synthesized
gcacugggccaugaauccga

SEQ ID NO: 687 - RNA, 20 nt, Artificial Sequence
  synthesized
ggauucauggcccagugcuu

SEQ ID NO: 688 - RNA, 20 nt, Artificial Sequence
  synthesized
aaggcuccacugagaggaag

SEQ ID NO: 689 - RNA, 20 nt, Artificial Sequence
  synthesized
aaggcucuacugagaggaag

SEQ ID NO: 690 - RNA, 20 nt, Artificial Sequence
  synthesized
agagccuuggggccgagccc

SEQ ID NO: 691 - RNA, 20 nt, Artificial Sequence
  synthesized
aguagagccuuggggccgag

SEQ ID NO: 692 - RNA, 20 nt, Artificial Sequence
  synthesized
aguggagccuuggggccgag

SEQ ID NO: 693 - RNA, 20 nt, Artificial Sequence
  synthesized
caguagagccuuggggccga

SEQ ID NO: 694 - RNA, 20 nt, Artificial Sequence
  synthesized
caguggagccuuggggccga

SEQ ID NO: 695 - RNA, 20 nt, Artificial Sequence
  synthesized
ccacugagaggaaggacacg

SEQ ID NO: 696 - RNA, 20 nt, Artificial Sequence
  synthesized
ccccaaggcuccacugagag

SEQ ID NO: 697 - RNA, 20 nt, Artificial Sequence
  synthesized
ccccaaggcucuacugagag

SEQ ID NO: 698 - RNA, 20 nt, Artificial Sequence
  synthesized
ccucucaguagagccuuggg

SEQ ID NO: 699 - RNA, 20 nt, Artificial Sequence
  synthesized
ccucucaguggagccuuggg

SEQ ID NO: 700 - RNA, 20 nt, Artificial Sequence
  synthesized
cggccccaaggcuccacuga

SEQ ID NO: 701 - RNA, 20 nt, Artificial Sequence
  synthesized
cggccccaaggcucuacuga

SEQ ID NO: 702 - RNA, 20 nt, Artificial Sequence
  synthesized
cguguccuuccucucaguag

SEQ ID NO: 703 - RNA, 20 nt, Artificial Sequence
  synthesized
cguguccuuccucucagugg

SEQ ID NO: 704 - RNA, 20 nt, Artificial Sequence
  synthesized
cuacugagaggaaggacacg

SEQ ID NO: 705 - RNA, 20 nt, Artificial Sequence
  synthesized
cucaguagagccuuggggcc

SEQ ID NO: 706 - RNA, 20 nt, Artificial Sequence
  synthesized
cucaguggagccuuggggcc

SEQ ID NO: 707 - RNA, 20 nt, Artificial Sequence
  synthesized
cuccacugagaggaaggaca

SEQ ID NO: 708 - RNA, 20 nt, Artificial Sequence
  synthesized
cucggccccaaggcuccacu

SEQ ID NO: 709 - RNA, 20 nt, Artificial Sequence
  synthesized
cucggccccaaggcucuacu

SEQ ID NO: 710 - RNA, 20 nt, Artificial Sequence
  synthesized
gcguguccuuccucucagua

SEQ ID NO: 711 - RNA, 20 nt, Artificial Sequence
  synthesized
gcguguccuuccucucagug

SEQ ID NO: 712 - RNA, 20 nt, Artificial Sequence
  synthesized
gcuccacugagaggaaggac

SEQ ID NO: 713 - RNA, 20 nt, Artificial Sequence
  synthesized
gcucuacugagaggaaggac

SEQ ID NO: 714 - RNA, 20 nt, Artificial Sequence
  synthesized
ggagccuuggggccgagccc

SEQ ID NO: 715 - RNA, 20 nt, Artificial Sequence
  synthesized
ggcuccacugagaggaagga

SEQ ID NO: 716 - RNA, 20 nt, Artificial Sequence
  synthesized
ggcucggccccaaggcucca

SEQ ID NO: 717 - RNA, 20 nt, Artificial Sequence
  synthesized
ggcucggccccaaggcucua

SEQ ID NO: 718 - RNA, 20 nt, Artificial Sequence
  synthesized
ggcucuacugagaggaagga

SEQ ID NO: 719 - RNA, 20 nt, Artificial Sequence
  synthesized
gggcucggccccaaggcucc

SEQ ID NO: 720 - RNA, 20 nt, Artificial Sequence
  synthesized
gggcucggccccaaggcucu

SEQ ID NO: 721 - RNA, 20 nt, Artificial Sequence
  synthesized
guagagccuuggggccgagc

SEQ ID NO: 722 - RNA, 20 nt, Artificial Sequence
  synthesized
guggagccuuggggccgagc

SEQ ID NO: 723 - RNA, 20 nt, Artificial Sequence
  synthesized
guguccuuccucucaguaga

SEQ ID NO: 724 - RNA, 20 nt, Artificial Sequence
  synthesized
guguccuuccucucagugga

SEQ ID NO: 725 - RNA, 20 nt, Artificial Sequence
  synthesized
uagagccuuggggccgagcc

SEQ ID NO: 726 - RNA, 20 nt, Artificial Sequence
  synthesized
ucaguagagccuuggggccg

SEQ ID NO: 727 - RNA, 20 nt, Artificial Sequence
  synthesized
ucaguggagccuuggggccg

SEQ ID NO: 728 - RNA, 20 nt, Artificial Sequence
  synthesized
uccacugagaggaaggacac

SEQ ID NO: 729 - RNA, 20 nt, Artificial Sequence
  synthesized
uccucucaguagagccuugg

SEQ ID NO: 730 - RNA, 20 nt, Artificial Sequence
  synthesized
uccucucaguggagccuugg

SEQ ID NO: 731 - RNA, 20 nt, Artificial Sequence
  synthesized
uccuuccucucaguagagcc

SEQ ID NO: 732 - RNA, 20 nt, Artificial Sequence
  synthesized
uccuuccucucaguggagcc

SEQ ID NO: 733 - RNA, 20 nt, Artificial Sequence
  synthesized
ucuacugagaggaaggacac

SEQ ID NO: 734 - RNA, 20 nt, Artificial Sequence
  synthesized
uggagccuuggggccgagcc

SEQ ID NO: 735 - RNA, 20 nt, Artificial Sequence
  synthesized
uguccuuccucucaguagag

SEQ ID NO: 736 - RNA, 20 nt, Artificial Sequence
  synthesized
uguccuuccucucaguggag

SEQ ID NO: 737 - RNA, 20 nt, Artificial Sequence
  synthesized
aagccaggacccucaguggg

SEQ ID NO: 738 - RNA, 20 nt, Artificial Sequence
  synthesized
acccucagugggaugaggag

SEQ ID NO: 739 - RNA, 20 nt, Artificial Sequence
  synthesized
aggacccucagugggaugag

SEQ ID NO: 740 - RNA, 20 nt, Artificial Sequence
  synthesized
aggauccucagugggaugag

SEQ ID NO: 741 - RNA, 20 nt, Artificial Sequence
  synthesized
aggauccuggcuucucugca

SEQ ID NO: 742 - RNA, 20 nt, Artificial Sequence
  synthesized
aggguccuggcuucucugca

SEQ ID NO: 743 - RNA, 20 nt, Artificial Sequence
  synthesized
aucccacugaggauccuggc

SEQ ID NO: 744 - RNA, 20 nt, Artificial Sequence
  synthesized
aucccacugaggguccuggc

SEQ ID NO: 745 - RNA, 20 nt, Artificial Sequence
  synthesized
auccucagugggaugaggag

SEQ ID NO: 746 - RNA, 20 nt, Artificial Sequence
  synthesized
auccuggcuucucugcagca

SEQ ID NO: 747 - RNA, 20 nt, Artificial Sequence
  synthesized
cacugaggauccuggcuucu

SEQ ID NO: 748 - RNA, 20 nt, Artificial Sequence
  synthesized
cacugaggguccuggcuucu

SEQ ID NO: 749 - RNA, 20 nt, Artificial Sequence
  synthesized
cagagaagccaggacccuca

SEQ ID NO: 750 - RNA, 20 nt, Artificial Sequence
  synthesized
cagagaagccaggauccuca

SEQ ID NO: 751 - RNA, 20 nt, Artificial Sequence
  synthesized
caucccacugaggauccugg

SEQ ID NO: 752 - RNA, 20 nt, Artificial Sequence
  synthesized
caucccacugaggguccugg

SEQ ID NO: 753 - RNA, 20 nt, Artificial Sequence
  synthesized
ccacugaggauccuggcuuc

SEQ ID NO: 754 - RNA, 20 nt, Artificial Sequence
  synthesized
ccacugaggguccuggcuuc

SEQ ID NO: 755 - RNA, 20 nt, Artificial Sequence
  synthesized
cccacugaggauccuggcuu

SEQ ID NO: 756 - RNA, 20 nt, Artificial Sequence
  synthesized
cccacugaggguccuggcuu

SEQ ID NO: 757 - RNA, 20 nt, Artificial Sequence
  synthesized
cccucagugggaugaggagc

SEQ ID NO: 758 - RNA, 20 nt, Artificial Sequence
  synthesized
cucaucccacugaggauccu

SEQ ID NO: 759 - RNA, 20 nt, Artificial Sequence
  synthesized
cucaucccacugaggguccu

SEQ ID NO: 760 - RNA, 20 nt, Artificial Sequence
  synthesized
cuccucaucccacugaggau

SEQ ID NO: 761 - RNA, 20 nt, Artificial Sequence
  synthesized
cuccucaucccacugagggu

SEQ ID NO: 762 - RNA, 20 nt, Artificial Sequence
  synthesized
cugaggauccuggcuucucu

SEQ ID NO: 763 - RNA, 20 nt, Artificial Sequence
  synthesized
cugaggguccuggcuucucu

SEQ ID NO: 764 - RNA, 20 nt, Artificial Sequence
  synthesized
cugcagagaagccaggaccc

SEQ ID NO: 765 - RNA, 20 nt, Artificial Sequence
  synthesized
cugcagagaagccaggaucc

SEQ ID NO: 766 - RNA, 20 nt, Artificial Sequence
  synthesized
gaagccaggacccucagugg

SEQ ID NO: 767 - RNA, 20 nt, Artificial Sequence
  synthesized
gaagccaggauccucagugg

SEQ ID NO: 768 - RNA, 20 nt, Artificial Sequence
  synthesized
gacccucagugggaugagga

SEQ ID NO: 769 - RNA, 20 nt, Artificial Sequence
  synthesized
gaggauccuggcuucucugc

SEQ ID NO: 770 - RNA, 20 nt, Artificial Sequence
  synthesized
gaggguccuggcuucucugc

SEQ ID NO: 771 - RNA, 20 nt, Artificial Sequence
  synthesized
gauccucagugggaugagga

SEQ ID NO: 772 - RNA, 20 nt, Artificial Sequence
  synthesized
gauccuggcuucucugcagc

SEQ ID NO: 773 - RNA, 20 nt, Artificial Sequence
  synthesized
gccaggacccucagugggau

SEQ ID NO: 774 - RNA, 20 nt, Artificial Sequence
  synthesized
gccaggauccucagugggau

SEQ ID NO: 775 - RNA, 20 nt, Artificial Sequence
  synthesized
gcuccucaucccacugagga

SEQ ID NO: 776 - RNA, 20 nt, Artificial Sequence
  synthesized
gcuccucaucccacugaggg

SEQ ID NO: 777 - RNA, 20 nt, Artificial Sequence
  synthesized
gcugcagagaagccaggacc

SEQ ID NO: 778 - RNA, 20 nt, Artificial Sequence
  synthesized
gcugcagagaagccaggauc

SEQ ID NO: 779 - RNA, 20 nt, Artificial Sequence
  synthesized
ggacccucagugggaugagg

SEQ ID NO: 780 - RNA, 20 nt, Artificial Sequence
  synthesized
ggauccucagugggaugagg

SEQ ID NO: 781 - RNA, 20 nt, Artificial Sequence
  synthesized
ggauccuggcuucucugcag

SEQ ID NO: 782 - RNA, 20 nt, Artificial Sequence
  synthesized
ggguccuggcuucucugcag

SEQ ID NO: 783 - RNA, 20 nt, Artificial Sequence
  synthesized
gguccuggcuucucugcagc

SEQ ID NO: 784 - RNA, 20 nt, Artificial Sequence
  synthesized
guccuggcuucucugcagca

SEQ ID NO: 785 - RNA, 20 nt, Artificial Sequence
  synthesized
ucaucccacugaggguccug

SEQ ID NO: 786 - RNA, 20 nt, Artificial Sequence
  synthesized
ucccacugaggauccuggcu

SEQ ID NO: 787 - RNA, 20 nt, Artificial Sequence
  synthesized
ucccacugaggguccuggcu

SEQ ID NO: 788 - RNA, 20 nt, Artificial Sequence
  synthesized
uccucagugggaugaggagc

SEQ ID NO: 789 - RNA, 20 nt, Artificial Sequence
  synthesized
uccucaucccacugaggauc

SEQ ID NO: 790 - RNA, 20 nt, Artificial Sequence
  synthesized
uccucaucccacugaggguc

SEQ ID NO: 791 - RNA, 20 nt, Artificial Sequence
  synthesized
ugcagagaagccaggacccu

SEQ ID NO: 792 - RNA, 20 nt, Artificial Sequence
  synthesized
ugcagagaagccaggauccu

SEQ ID NO: 793 - RNA, 20 nt, Artificial Sequence
  synthesized
ugcugcagagaagccaggac

SEQ ID NO: 794 - RNA, 20 nt, Artificial Sequence
  synthesized
ugcugcagagaagccaggau

SEQ ID NO: 795 - RNA, 20 nt, Artificial Sequence
  synthesized
aacuguaggacuucugagag

SEQ ID NO: 796 - RNA, 20 nt, Artificial Sequence
  synthesized
aaggcucucagaaguccuac

SEQ ID NO: 797 - RNA, 20 nt, Artificial Sequence
  synthesized
agaaguccuacaguuaaauu

SEQ ID NO: 798 - RNA, 20 nt, Artificial Sequence
  synthesized
aggcucucagaaguccuaca

SEQ ID NO: 799 - RNA, 20 nt, Artificial Sequence
  synthesized
cagaaguccuacaguuaaau

SEQ ID NO: 800 - RNA, 20 nt, Artificial Sequence
  synthesized
cucucagaaguccuacaguu

SEQ ID NO: 801 - RNA, 20 nt, Artificial Sequence
  synthesized
gaaguccuacaguuaaauuu

SEQ ID NO: 802 - RNA, 20 nt, Artificial Sequence
  synthesized
ggcucucagaaguccuacag

SEQ ID NO: 803 - RNA, 20 nt, Artificial Sequence
  synthesized
uaacuguaggacuucugaga

SEQ ID NO: 804 - RNA, 20 nt, Artificial Sequence
  synthesized
ucagaaguccuacaguuaaa

SEQ ID NO: 805 - RNA, 20 nt, Artificial Sequence
  synthesized
uuaacuguaggacuucugag

SEQ ID NO: 806 - RNA, 20 nt, Artificial Sequence
  synthesized
aaaggcucucagaaguccgg

SEQ ID NO: 807 - RNA, 20 nt, Artificial Sequence
  synthesized
aaauaaauuuaacugccgga

SEQ ID NO: 808 - RNA, 20 nt, Artificial Sequence
  synthesized
aacugccggacuucugagag

SEQ ID NO: 809 - RNA, 20 nt, Artificial Sequence
  synthesized
aaggcucucagaaguccggc

SEQ ID NO: 810 - RNA, 20 nt, Artificial Sequence
  synthesized
aauaaauuuaacugccggac

SEQ ID NO: 811 - RNA, 20 nt, Artificial Sequence
  synthesized
acugccggacuucugagagc

SEQ ID NO: 812 - RNA, 20 nt, Artificial Sequence
  synthesized
agaaguccggcaguuaaauu

SEQ ID NO: 813 - RNA, 20 nt, Artificial Sequence
  synthesized
aggcucucagaaguccggca

SEQ ID NO: 814 - RNA, 20 nt, Artificial Sequence
  synthesized
aguccggcaguuaaauuuau

SEQ ID NO: 815 - RNA, 20 nt, Artificial Sequence
  synthesized
auaaauuuaacugccggacu

SEQ ID NO: 816 - RNA, 20 nt, Artificial Sequence
  synthesized
caaauaaauuuaacugccgg

SEQ ID NO: 817 - RNA, 20 nt, Artificial Sequence
  synthesized
cagaaguccggcaguuaaau

SEQ ID NO: 818 - RNA, 20 nt, Artificial Sequence
  synthesized
ccggacuucugagagccuuu

SEQ ID NO: 819 - RNA, 20 nt, Artificial Sequence
  synthesized
ccggcaguuaaauuuauuug

SEQ ID NO: 820 - RNA, 20 nt, Artificial Sequence
  synthesized
cggacuucugagagccuuua

SEQ ID NO: 821 - RNA, 20 nt, Artificial Sequence
  synthesized
cggcaguuaaauuuauuuga

SEQ ID NO: 822 - RNA, 20 nt, Artificial Sequence
  synthesized
cucagaaguccggcaguuaa

SEQ ID NO: 823 - RNA, 20 nt, Artificial Sequence
  synthesized
cucucagaaguccggcaguu

SEQ ID NO: 824 - RNA, 20 nt, Artificial Sequence
  synthesized
gaaguccggcaguuaaauuu

SEQ ID NO: 825 - RNA, 20 nt, Artificial Sequence
  synthesized
gccggacuucugagagccuu

SEQ ID NO: 826 - RNA, 20 nt, Artificial Sequence
  synthesized
gcucucagaaguccggcagu

SEQ ID NO: 827 - RNA, 20 nt, Artificial Sequence
  synthesized
ggcaguuaaauuuauuugac

SEQ ID NO: 828 - RNA, 20 nt, Artificial Sequence
  synthesized
ggcucucagaaguccggcag

SEQ ID NO: 829 - RNA, 20 nt, Artificial Sequence
  synthesized
uaaauuuaacugccggacuu

SEQ ID NO: 830 - RNA, 20 nt, Artificial Sequence
  synthesized
uaacugccggacuucugaga

SEQ ID NO: 831 - RNA, 20 nt, Artificial Sequence
  synthesized
ucaaauaaauuuaacugccg

SEQ ID NO: 832 - RNA, 20 nt, Artificial Sequence
  synthesized
ucagaaguccggcaguuaaa

SEQ ID NO: 833 - RNA, 20 nt, Artificial Sequence
  synthesized
uccggcaguuaaauuuauuu

SEQ ID NO: 834 - RNA, 20 nt, Artificial Sequence
  synthesized
ucucagaaguccggcaguua

SEQ ID NO: 835 - RNA, 20 nt, Artificial Sequence
  synthesized
ugccggacuucugagagccu

SEQ ID NO: 836 - RNA, 20 nt, Artificial Sequence
  synthesized
uuaacugccggacuucugag

SEQ ID NO: 837 - RNA, 20 nt, Artificial Sequence
  synthesized
uuuaacugccggacuucuga

SEQ ID NO: 838 - RNA, 20 nt, Artificial Sequence
  synthesized
aaauuaggaagaucacuggc

SEQ ID NO: 839 - RNA, 20 nt, Artificial Sequence
  synthesized
aaauuaggaaggucacuggc

SEQ ID NO: 840 - RNA, 20 nt, Artificial Sequence
  synthesized
aagagaaauuaggaagauca

SEQ ID NO: 841 - RNA, 20 nt, Artificial Sequence
  synthesized
aagagaaauuaggaagguca

SEQ ID NO: 842 - RNA, 20 nt, Artificial Sequence
  synthesized
aagaucacuggcacccucuc

SEQ ID NO: 843 - RNA, 20 nt, Artificial Sequence
  synthesized
aaggucacuggcacccucuc

SEQ ID NO: 844 - RNA, 20 nt, Artificial Sequence
  synthesized
aauuaggaagaucacuggca

SEQ ID NO: 845 - RNA, 20 nt, Artificial Sequence
  synthesized
aauuaggaaggucacuggca

SEQ ID NO: 846 - RNA, 20 nt, Artificial Sequence
  synthesized
accuuccuaauuucucuucc

SEQ ID NO: 847 - RNA, 20 nt, Artificial Sequence
  synthesized
agaaauuaggaagaucacug

SEQ ID NO: 848 - RNA, 20 nt, Artificial Sequence
  synthesized
agaaauuaggaaggucacug

SEQ ID NO: 849 - RNA, 20 nt, Artificial Sequence
  synthesized
agagggugccagugaccuuc

SEQ ID NO: 850 - RNA, 20 nt, Artificial Sequence
  synthesized
agagggugccagugaucuuc

SEQ ID NO: 851 - RNA, 20 nt, Artificial Sequence
  synthesized
agaucacuggcacccucuca

SEQ ID NO: 852 - RNA, 20 nt, Artificial Sequence
  synthesized
aggaagagaaauuaggaaga

SEQ ID NO: 853 - RNA, 20 nt, Artificial Sequence
  synthesized
aggaagagaaauuaggaagg

SEQ ID NO: 854 - RNA, 20 nt, Artificial Sequence
  synthesized
agggugccagugaccuuccu

SEQ ID NO: 855 - RNA, 20 nt, Artificial Sequence
  synthesized
agggugccagugaucuuccu

SEQ ID NO: 856 - RNA, 20 nt, Artificial Sequence
  synthesized
aggucacuggcacccucuca

SEQ ID NO: 857 - RNA, 20 nt, Artificial Sequence
  synthesized
agugaccuuccuaauuucuc

SEQ ID NO: 858 - RNA, 20 nt, Artificial Sequence
  synthesized
agugaucuuccuaauuucuc

SEQ ID NO: 859 - RNA, 20 nt, Artificial Sequence
  synthesized
aucacuggcacccucucaac

SEQ ID NO: 860 - RNA, 20 nt, Artificial Sequence
  synthesized
aucuuccuaauuucucuucc

SEQ ID NO: 861 - RNA, 20 nt, Artificial Sequence
  synthesized
auuaggaagaucacuggcac

SEQ ID NO: 862 - RNA, 20 nt, Artificial Sequence
  synthesized
auuaggaaggucacuggcac

SEQ ID NO: 863 - RNA, 20 nt, Artificial Sequence
  synthesized
cagugaccuuccuaauuucu

SEQ ID NO: 864 - RNA, 20 nt, Artificial Sequence
  synthesized
cagugaucuuccuaauuucu

SEQ ID NO: 865 - RNA, 20 nt, Artificial Sequence
  synthesized
ccagugaccuuccuaauuuc

SEQ ID NO: 866 - RNA, 20 nt, Artificial Sequence
  synthesized
ccagugaucuuccuaauuuc

SEQ ID NO: 867 - RNA, 20 nt, Artificial Sequence
  synthesized
ccuuccuaauuucucuuccu

SEQ ID NO: 868 - RNA, 20 nt, Artificial Sequence
  synthesized
gaaauuaggaagaucacugg

SEQ ID NO: 869 - RNA, 20 nt, Artificial Sequence
  synthesized
gaaauuaggaaggucacugg

SEQ ID NO: 870 - RNA, 20 nt, Artificial Sequence
  synthesized
agccccccuccgagcccagc

SEQ ID NO: 871 - RNA, 20 nt, Artificial Sequence
  synthesized
ccccccuccgagcccagcca

SEQ ID NO: 872 - RNA, 20 nt, Artificial Sequence
  synthesized
cccugggagccccccuccaa

SEQ ID NO: 873 - RNA, 20 nt, Artificial Sequence
  synthesized
cccugggagccccccuccga

SEQ ID NO: 874 - RNA, 20 nt, Artificial Sequence
  synthesized
cucggaggggggcucccagg

SEQ ID NO: 875 - RNA, 20 nt, Artificial Sequence
  synthesized
cuggcugggcucggaggggg

SEQ ID NO: 876 - RNA, 20 nt, Artificial Sequence
  synthesized
cuggcugggcuuggaggggg

SEQ ID NO: 877 - RNA, 20 nt, Artificial Sequence
  synthesized
cuuggaggggggcucccagg

SEQ ID NO: 878 - RNA, 20 nt, Artificial Sequence
  synthesized
gagccccccuccaagcccag

SEQ ID NO: 879 - RNA, 20 nt, Artificial Sequence
  synthesized
gagccccccuccgagcccag

SEQ ID NO: 880 - RNA, 20 nt, Artificial Sequence
  synthesized
gcccugggagccccccucca

SEQ ID NO: 881 - RNA, 20 nt, Artificial Sequence
  synthesized
gcuggcugggcucggagggg

SEQ ID NO: 882 - RNA, 20 nt, Artificial Sequence
  synthesized
gcugggcucggaggggggcu

SEQ ID NO: 883 - RNA, 20 nt, Artificial Sequence
  synthesized
gcugggcuuggaggggggcu

SEQ ID NO: 884 - RNA, 20 nt, Artificial Sequence
  synthesized
ggcugggcuuggaggggggc

SEQ ID NO: 885 - RNA, 20 nt, Artificial Sequence
  synthesized
gggagccccccuccaagccc

SEQ ID NO: 886 - RNA, 20 nt, Artificial Sequence
  synthesized
ucggaggggggcucccaggg

SEQ ID NO: 887 - RNA, 20 nt, Artificial Sequence
  synthesized
uggcugggcucggagggggg

SEQ ID NO: 888 - RNA, 20 nt, Artificial Sequence
  synthesized
uggcugggcuuggagggggg

SEQ ID NO: 889 - RNA, 20 nt, Artificial Sequence
  synthesized
ugggagccccccuccaagcc

SEQ ID NO: 890 - RNA, 20 nt, Artificial Sequence
  synthesized
ugggagccccccuccgagcc

SEQ ID NO: 891 - RNA, 20 nt, Artificial Sequence
  synthesized
uuggaggggggcucccaggg

SEQ ID NO: 892 - RNA, 20 nt, Artificial Sequence
  synthesized
gaagaucacuggcacccucu

SEQ ID NO: 893 - RNA, 20 nt, Artificial Sequence
  synthesized
gaaggucacuggcacccucu

SEQ ID NO: 894 - RNA, 20 nt, Artificial Sequence
  synthesized
gaccuuccuaauuucucuuc

SEQ ID NO: 895 - RNA, 20 nt, Artificial Sequence
  synthesized
gagaaauuaggaagaucacu

SEQ ID NO: 896 - RNA, 20 nt, Artificial Sequence
  synthesized
gagaaauuaggaaggucacu

SEQ ID NO: 897 - RNA, 20 nt, Artificial Sequence
  synthesized
gagagggugccagugaccuu

SEQ ID NO: 898 - RNA, 20 nt, Artificial Sequence
  synthesized
gagagggugccagugaucuu

SEQ ID NO: 899 - RNA, 20 nt, Artificial Sequence
  synthesized
gagggugccagugaccuucc

SEQ ID NO: 900 - RNA, 20 nt, Artificial Sequence
  synthesized
gagggugccagugaucuucc

SEQ ID NO: 901 - RNA, 20 nt, Artificial Sequence
  synthesized
gaucacuggcacccucucaa

SEQ ID NO: 902 - RNA, 20 nt, Artificial Sequence
  synthesized
gccagugaccuuccuaauuu

SEQ ID NO: 903 - RNA, 20 nt, Artificial Sequence
  synthesized
gccagugaucuuccuaauuu

SEQ ID NO: 904 - RNA, 20 nt, Artificial Sequence
  synthesized
ggaagagaaauuaggaagau

SEQ ID NO: 905 - RNA, 20 nt, Artificial Sequence
  synthesized
ggaagagaaauuaggaaggu

SEQ ID NO: 906 - RNA, 20 nt, Artificial Sequence
  synthesized
ggaagaucacuggcacccuc

SEQ ID NO: 907 - RNA, 20 nt, Artificial Sequence
  synthesized
ggaaggucacuggcacccuc

SEQ ID NO: 908 - RNA, 20 nt, Artificial Sequence
  synthesized
gggugccagugaccuuccua

SEQ ID NO: 909 - RNA, 20 nt, Artificial Sequence
  synthesized
gggugccagugaucuuccua

SEQ ID NO: 910 - RNA, 20 nt, Artificial Sequence
  synthesized
ggucacuggcacccucucaa

SEQ ID NO: 911 - RNA, 20 nt, Artificial Sequence
  synthesized
ggugccagugaccuuccuaa

SEQ ID NO: 912 - RNA, 20 nt, Artificial Sequence
  synthesized
ggugccagugaucuuccuaa

SEQ ID NO: 913 - RNA, 20 nt, Artificial Sequence
  synthesized
gucacuggcacccucucaac

SEQ ID NO: 914 - RNA, 20 nt, Artificial Sequence
  synthesized
gugaccuuccuaauuucucu

SEQ ID NO: 915 - RNA, 20 nt, Artificial Sequence
  synthesized
gugaucuuccuaauuucucu

SEQ ID NO: 916 - RNA, 20 nt, Artificial Sequence
  synthesized
gugccagugaccuuccuaau

SEQ ID NO: 917 - RNA, 20 nt, Artificial Sequence
  synthesized
gugccagugaucuuccuaau

SEQ ID NO: 918 - RNA, 20 nt, Artificial Sequence
  synthesized
guugagagggugccagugac

SEQ ID NO: 919 - RNA, 20 nt, Artificial Sequence
  synthesized
guugagagggugccagugau

SEQ ID NO: 920 - RNA, 20 nt, Artificial Sequence
  synthesized
uaggaagaucacuggcaccc

SEQ ID NO: 921 - RNA, 20 nt, Artificial Sequence
  synthesized
uaggaaggucacuggcaccc

SEQ ID NO: 922 - RNA, 20 nt, Artificial Sequence
  synthesized
ucuuccuaauuucucuuccu

SEQ ID NO: 923 - RNA, 20 nt, Artificial Sequence
  synthesized
ugaccuuccuaauuucucuu

SEQ ID NO: 924 - RNA, 20 nt, Artificial Sequence
  synthesized
ugagagggugccagugaccu

SEQ ID NO: 925 - RNA, 20 nt, Artificial Sequence
  synthesized
ugagagggugccagugaucu

SEQ ID NO: 926 - RNA, 20 nt, Artificial Sequence
  synthesized
ugccagugaccuuccuaauu

SEQ ID NO: 927 - RNA, 20 nt, Artificial Sequence
  synthesized
ugccagugaucuuccuaauu

SEQ ID NO: 928 - RNA, 20 nt, Artificial Sequence
  synthesized
uuaggaagaucacuggcacc

SEQ ID NO: 929 - RNA, 20 nt, Artificial Sequence
  synthesized
uuaggaaggucacuggcacc

SEQ ID NO: 930 - RNA, 20 nt, Artificial Sequence
  synthesized
uugagagggugccagugacc

SEQ ID NO: 931 - RNA, 20 nt, Artificial Sequence
  synthesized
uugagagggugccagugauc

SEQ ID NO: 932 - RNA, 20 nt, Artificial Sequence
  synthesized
aaccagacuccacagccucc

SEQ ID NO: 933 - RNA, 20 nt, Artificial Sequence
  synthesized
acccagacuccacagccucc

SEQ ID NO: 934 - RNA, 20 nt, Artificial Sequence
  synthesized
agaguggguccccccaacca

SEQ ID NO: 935 - RNA, 20 nt, Artificial Sequence
  synthesized
agaguggguccccccaccca

SEQ ID NO: 936 - RNA, 20 nt, Artificial Sequence
  synthesized
agucuggguggggggaccca

SEQ ID NO: 937 - RNA, 20 nt, Artificial Sequence
  synthesized
agucugguuggggggaccca

SEQ ID NO: 938 - RNA, 20 nt, Artificial Sequence
  synthesized
caagaguggguccccccaac

SEQ ID NO: 939 - RNA, 20 nt, Artificial Sequence
  synthesized
caagaguggguccccccacc

SEQ ID NO: 940 - RNA, 20 nt, Artificial Sequence
  synthesized
cacccagacuccacagccuc

SEQ ID NO: 941 - RNA, 20 nt, Artificial Sequence
  synthesized
ccaaccagacuccacagccu

SEQ ID NO: 942 - RNA, 20 nt, Artificial Sequence
  synthesized
ccaagaguggguccccccaa

SEQ ID NO: 943 - RNA, 20 nt, Artificial Sequence
  synthesized
ccaagaguggguccccccac

SEQ ID NO: 944 - RNA, 20 nt, Artificial Sequence
  synthesized
ccacccagacuccacagccu

SEQ ID NO: 945 - RNA, 20 nt, Artificial Sequence
  synthesized
cccaaccagacuccacagcc

SEQ ID NO: 946 - RNA, 20 nt, Artificial Sequence
  synthesized
cccacccagacuccacagcc

SEQ ID NO: 947 - RNA, 20 nt, Artificial Sequence
  synthesized
cccagacuccacagccuccu

SEQ ID NO: 948 - RNA, 20 nt, Artificial Sequence
  synthesized
ccccaaccagacuccacagc

SEQ ID NO: 949 - RNA, 20 nt, Artificial Sequence
  synthesized
cccccaaccagacuccacag

SEQ ID NO: 950 - RNA, 20 nt, Artificial Sequence
  synthesized
cccccacccagacuccacag

SEQ ID NO: 951 - RNA, 20 nt, Artificial Sequence
  synthesized
ccccccaaccagacuccaca

SEQ ID NO: 952 - RNA, 20 nt, Artificial Sequence
  synthesized
ccccccacccagacuccaca

SEQ ID NO: 953 - RNA, 20 nt, Artificial Sequence
  synthesized
cuggguggggggacccacuc

SEQ ID NO: 954 - RNA, 20 nt, Artificial Sequence
  synthesized
cugguuggggggacccacuc

SEQ ID NO: 955 - RNA, 20 nt, Artificial Sequence
  synthesized
cuguggagucuggguggggg

SEQ ID NO: 956 - RNA, 20 nt, Artificial Sequence
  synthesized
cuguggagucugguuggggg

SEQ ID NO: 957 - RNA, 20 nt, Artificial Sequence
  synthesized
ggagucuggguggggggacc

SEQ ID NO: 958 - RNA, 20 nt, Artificial Sequence
  synthesized
ggagucugguuggggggacc

SEQ ID NO: 959 - RNA, 20 nt, Artificial Sequence
  synthesized
ggguggggggacccacucuu

SEQ ID NO: 960 - RNA, 20 nt, Artificial Sequence
  synthesized
gguccccccaaccagacucc

SEQ ID NO: 961 - RNA, 20 nt, Artificial Sequence
  synthesized
gguccccccacccagacucc

SEQ ID NO: 962 - RNA, 20 nt, Artificial Sequence
  synthesized
gguggggggacccacucuug

SEQ ID NO: 963 - RNA, 20 nt, Artificial Sequence
  synthesized
gguuggggggacccacucuu

SEQ ID NO: 964 - RNA, 20 nt, Artificial Sequence
  synthesized
guccccccaaccagacucca

SEQ ID NO: 965 - RNA, 20 nt, Artificial Sequence
  synthesized
guccccccacccagacucca

SEQ ID NO: 966 - RNA, 20 nt, Artificial Sequence
  synthesized
gucuggguggggggacccac

SEQ ID NO: 967 - RNA, 20 nt, Artificial Sequence
  synthesized
gucugguuggggggacccac

SEQ ID NO: 968 - RNA, 20 nt, Artificial Sequence
  synthesized
guggagucugggugggggga

SEQ ID NO: 969 - RNA, 20 nt, Artificial Sequence
  synthesized
guggggggacccacucuugg

SEQ ID NO: 970 - RNA, 20 nt, Artificial Sequence
  synthesized
guggguccccccaaccagac

SEQ ID NO: 971 - RNA, 20 nt, Artificial Sequence
  synthesized
guggguccccccacccagac

SEQ ID NO: 972 - RNA, 20 nt, Artificial Sequence
  synthesized
guuggggggacccacucuug

SEQ ID NO: 973 - RNA, 20 nt, Artificial Sequence
  synthesized
uccccccaaccagacuccac

SEQ ID NO: 974 - RNA, 20 nt, Artificial Sequence
  synthesized
uccccccacccagacuccac

SEQ ID NO: 975 - RNA, 20 nt, Artificial Sequence
  synthesized
uggagucuggguggggggac

SEQ ID NO: 976 - RNA, 20 nt, Artificial Sequence
  synthesized
uggagucugguuggggggac

SEQ ID NO: 977 - RNA, 20 nt, Artificial Sequence
  synthesized
uggguccccccacccagacu

SEQ ID NO: 978 - RNA, 20 nt, Artificial Sequence
  synthesized
uguggagucugggugggggg

SEQ ID NO: 979 - RNA, 20 nt, Artificial Sequence
  synthesized
uguggagucugguugggggg

SEQ ID NO: 980 - RNA, 20 nt, Artificial Sequence
  synthesized
uuggggggacccacucuugg

SEQ ID NO: 981 - RNA, 20 nt, Artificial Sequence
  synthesized
aacggugggcuugggagugc

SEQ ID NO: 982 - RNA, 20 nt, Artificial Sequence
  synthesized
aacggugggcuugggagugg

SEQ ID NO: 983 - RNA, 20 nt, Artificial Sequence
  synthesized
aaggcagccacucccaagcc

SEQ ID NO: 984 - RNA, 20 nt, Artificial Sequence
  synthesized
aaggcaggcacucccaagcc

SEQ ID NO: 985 - RNA, 20 nt, Artificial Sequence
  synthesized
acaauaaggcagccacuccc

SEQ ID NO: 986 - RNA, 20 nt, Artificial Sequence
  synthesized
acaauaaggcaggcacuccc

SEQ ID NO: 987 - RNA, 20 nt, Artificial Sequence
  synthesized
acggugggcuugggagugcc

SEQ ID NO: 988 - RNA, 20 nt, Artificial Sequence
  synthesized
acggugggcuugggaguggc

SEQ ID NO: 989 - RNA, 20 nt, Artificial Sequence
  synthesized
agccacucccaagcccaccg

SEQ ID NO: 990 - RNA, 20 nt, Artificial Sequence
  synthesized
aggcacucccaagcccaccg

SEQ ID NO: 991 - RNA, 20 nt, Artificial Sequence
  synthesized
aggcagccacucccaagccc

SEQ ID NO: 992 - RNA, 20 nt, Artificial Sequence
  synthesized
aggcaggcacucccaagccc

SEQ ID NO: 993 - RNA, 20 nt, Artificial Sequence
  synthesized
auaaggcagccacucccaag

SEQ ID NO: 994 - RNA, 20 nt, Artificial Sequence
  synthesized
auaaggcaggcacucccaag

SEQ ID NO: 995 - RNA, 20 nt, Artificial Sequence
  synthesized
caauaaggcagccacuccca

SEQ ID NO: 996 - RNA, 20 nt, Artificial Sequence
  synthesized
caauaaggcaggcacuccca

SEQ ID NO: 997 - RNA, 20 nt, Artificial Sequence
  synthesized
cagccacucccaagcccacc

SEQ ID NO: 998 - RNA, 20 nt, Artificial Sequence
  synthesized
caggcacucccaagcccacc

SEQ ID NO: 999 - RNA, 20 nt, Artificial Sequence
  synthesized
ccacucccaagcccaccguu

SEQ ID NO: 1000 - RNA, 20 nt, Artificial Sequence
  synthesized
ccugccuuauuguagagacc

SEQ ID NO: 1001 - RNA, 20 nt, Artificial Sequence
  synthesized
cggugggcuugggagugccu

SEQ ID NO: 1002 - RNA, 20 nt, Artificial Sequence
  synthesized
cggugggcuugggaguggcu

SEQ ID NO: 1003 - RNA, 20 nt, Artificial Sequence
  synthesized
cucuacaauaaggcagccac

SEQ ID NO: 1004 - RNA, 20 nt, Artificial Sequence
  synthesized
cucuacaauaaggcaggcac

SEQ ID NO: 1005 - RNA, 20 nt, Artificial Sequence
  synthesized
cuugggagugccugccuuau

SEQ ID NO: 1006 - RNA, 20 nt, Artificial Sequence
  synthesized
cuugggaguggcugccuuau

SEQ ID NO: 1007 - RNA, 20 nt, Artificial Sequence
  synthesized
gcacucccaagcccaccguu

SEQ ID NO: 1008 - RNA, 20 nt, Artificial Sequence
  synthesized
gcagccacucccaagcccac

SEQ ID NO: 1009 - RNA, 20 nt, Artificial Sequence
  synthesized
gcaggcacucccaagcccac

SEQ ID NO: 1010 - RNA, 20 nt, Artificial Sequence
  synthesized
gccacucccaagcccaccgu

SEQ ID NO: 1011 - RNA, 20 nt, Artificial Sequence
  synthesized
gccugccuuauuguagagac

SEQ ID NO: 1012 - RNA, 20 nt, Artificial Sequence
  synthesized
gcugccuuauuguagagacc

SEQ ID NO: 1013 - RNA, 20 nt, Artificial Sequence
  synthesized
gcuugggagugccugccuua

SEQ ID NO: 1014 - RNA, 20 nt, Artificial Sequence
  synthesized
gcuugggaguggcugccuua

SEQ ID NO: 1015 - RNA, 20 nt, Artificial Sequence
  synthesized
ggagugccugccuuauugua

SEQ ID NO: 1016 - RNA, 20 nt, Artificial Sequence
  synthesized
ggaguggcugccuuauugua

SEQ ID NO: 1017 - RNA, 20 nt, Artificial Sequence
  synthesized
ggcacucccaagcccaccgu

SEQ ID NO: 1018 - RNA, 20 nt, Artificial Sequence
  synthesized
ggcagccacucccaagccca

SEQ ID NO: 1019 - RNA, 20 nt, Artificial Sequence
  synthesized
ggcaggcacucccaagccca

SEQ ID NO: 1020 - RNA, 20 nt, Artificial Sequence
  synthesized
ggcugccuuauuguagagac

SEQ ID NO: 1021 - RNA, 20 nt, Artificial Sequence
  synthesized
ggcuugggagugccugccuu

SEQ ID NO: 1022 - RNA, 20 nt, Artificial Sequence
  synthesized
ggcuugggaguggcugccuu

SEQ ID NO: 1023 - RNA, 20 nt, Artificial Sequence
  synthesized
gggcuugggagugccugccu

SEQ ID NO: 1024 - RNA, 20 nt, Artificial Sequence
  synthesized
gggcuugggaguggcugccu

SEQ ID NO: 1025 - RNA, 20 nt, Artificial Sequence
  synthesized
ggucucuacaauaaggcagc

SEQ ID NO: 1026 - RNA, 20 nt, Artificial Sequence
  synthesized
ggucucuacaauaaggcagg

SEQ ID NO: 1027 - RNA, 20 nt, Artificial Sequence
  synthesized
ggugggcuugggagugccug

SEQ ID NO: 1028 - RNA, 20 nt, Artificial Sequence
  synthesized
ggugggcuugggaguggcug

SEQ ID NO: 1029 - RNA, 20 nt, Artificial Sequence
  synthesized
gucucuacaauaaggcagcc

SEQ ID NO: 1030 - RNA, 20 nt, Artificial Sequence
  synthesized
gugccugccuuauuguagag

SEQ ID NO: 1031 - RNA, 20 nt, Artificial Sequence
  synthesized
guggcugccuuauuguagag

SEQ ID NO: 1032 - RNA, 20 nt, Artificial Sequence
  synthesized
gugggcuugggagugccugc

SEQ ID NO: 1033 - RNA, 20 nt, Artificial Sequence
  synthesized
gugggcuugggaguggcugc

SEQ ID NO: 1034 - RNA, 20 nt, Artificial Sequence
  synthesized
uaaggcagccacucccaagc

SEQ ID NO: 1035 - RNA, 20 nt, Artificial Sequence
  synthesized
uaaggcaggcacucccaagc

SEQ ID NO: 1036 - RNA, 20 nt, Artificial Sequence
  synthesized
uacaauaaggcagccacucc

SEQ ID NO: 1037 - RNA, 20 nt, Artificial Sequence
  synthesized
uacaauaaggcaggcacucc

SEQ ID NO: 1038 - RNA, 20 nt, Artificial Sequence
  synthesized
ucuacaauaaggcagccacu

SEQ ID NO: 1039 - RNA, 20 nt, Artificial Sequence
  synthesized
ucuacaauaaggcaggcacu

SEQ ID NO: 1040 - RNA, 20 nt, Artificial Sequence
  synthesized
ucucuacaauaaggcagcca

SEQ ID NO: 1041 - RNA, 20 nt, Artificial Sequence
  synthesized
ucucuacaauaaggcaggca

SEQ ID NO: 1042 - RNA, 20 nt, Artificial Sequence
  synthesized
ugccugccuuauuguagaga

SEQ ID NO: 1043 - RNA, 20 nt, Artificial Sequence
  synthesized
uggcugccuuauuguagaga

SEQ ID NO: 1044 - RNA, 20 nt, Artificial Sequence
  synthesized
ugggagugccugccuuauug

SEQ ID NO: 1045 - RNA, 20 nt, Artificial Sequence
  synthesized
ugggaguggcugccuuauug

SEQ ID NO: 1046 - RNA, 20 nt, Artificial Sequence
  synthesized
ugggcuugggagugccugcc

SEQ ID NO: 1047 - RNA, 20 nt, Artificial Sequence
  synthesized
ugggcuugggaguggcugcc

SEQ ID NO: 1048 - RNA, 20 nt, Artificial Sequence
  synthesized
uugggagugccugccuuauu

SEQ ID NO: 1049 - RNA, 20 nt, Artificial Sequence
  synthesized
uugggaguggcugccuuauu

SEQ ID NO: 1050 - RNA, 20 nt, Artificial Sequence
  synthesized
aaacacagacuguuacaucu

SEQ ID NO: 1051 - RNA, 20 nt, Artificial Sequence
  synthesized
aaacacagacuguuccaucu

SEQ ID NO: 1052 - RNA, 20 nt, Artificial Sequence
  synthesized
acacagacuguuacaucugu

SEQ ID NO: 1053 - RNA, 20 nt, Artificial Sequence
  synthesized
acacagacuguuccaucugu

SEQ ID NO: 1054 - RNA, 20 nt, Artificial Sequence
  synthesized
acacagauggaacagucugu

SEQ ID NO: 1055 - RNA, 20 nt, Artificial Sequence
  synthesized
acacagauguaacagucugu

SEQ ID NO: 1056 - RNA, 20 nt, Artificial Sequence
  synthesized
acagacuguuacaucugugu

SEQ ID NO: 1057 - RNA, 20 nt, Artificial Sequence
  synthesized
acagacuguuccaucugugu

SEQ ID NO: 1058 - RNA, 20 nt, Artificial Sequence
  synthesized
acagauggaacagucugugu

SEQ ID NO: 1059 - RNA, 20 nt, Artificial Sequence
  synthesized
acagauguaacagucugugu

SEQ ID NO: 1060 - RNA, 20 nt, Artificial Sequence
  synthesized
agauggaacagucuguguuu

SEQ ID NO: 1061 - RNA, 20 nt, Artificial Sequence
  synthesized
aggaaaacacagacuguucc

SEQ ID NO: 1062 - RNA, 20 nt, Artificial Sequence
  synthesized
auggaacagucuguguuuuc

SEQ ID NO: 1063 - RNA, 20 nt, Artificial Sequence
  synthesized
auguaacagucuguguuuuc

SEQ ID NO: 1064 - RNA, 20 nt, Artificial Sequence
  synthesized
cacacagauggaacagucug

SEQ ID NO: 1065 - RNA, 20 nt, Artificial Sequence
  synthesized
cacacagauguaacagucug

SEQ ID NO: 1066 - RNA, 20 nt, Artificial Sequence
  synthesized
cacagacuguuacaucugug

SEQ ID NO: 1067 - RNA, 20 nt, Artificial Sequence
  synthesized
cacagacuguuccaucugug

SEQ ID NO: 1068 - RNA, 20 nt, Artificial Sequence
  synthesized
cacagauggaacagucugug

SEQ ID NO: 1069 - RNA, 20 nt, Artificial Sequence
  synthesized
cacagauguaacagucugug

SEQ ID NO: 1070 - RNA, 20 nt, Artificial Sequence
  synthesized
cagacuguuacaucugugug

SEQ ID NO: 1071 - RNA, 20 nt, Artificial Sequence
  synthesized
cagacuguuccaucugugug

SEQ ID NO: 1072 - RNA, 20 nt, Artificial Sequence
  synthesized
cagauggaacagucuguguu

SEQ ID NO: 1073 - RNA, 20 nt, Artificial Sequence
  synthesized
cagauguaacagucuguguu

SEQ ID NO: 1074 - RNA, 20 nt, Artificial Sequence
  synthesized
caggaaaacacagacuguuc

SEQ ID NO: 1075 - RNA, 20 nt, Artificial Sequence
  synthesized
ccccucugcacacagaugga

SEQ ID NO: 1076 - RNA, 20 nt, Artificial Sequence
  synthesized
ccccucugcacacagaugua

SEQ ID NO: 1077 - RNA, 20 nt, Artificial Sequence
  synthesized
cccucugcacacagauggaa

SEQ ID NO: 1078 - RNA, 20 nt, Artificial Sequence
  synthesized
cccucugcacacagauguaa

SEQ ID NO: 1079 - RNA, 20 nt, Artificial Sequence
  synthesized
ccucugcacacagauggaac

SEQ ID NO: 1080 - RNA, 20 nt, Artificial Sequence
  synthesized
ccucugcacacagauguaac

SEQ ID NO: 1081 - RNA, 20 nt, Artificial Sequence
  synthesized
cucugcacacagauggaaca

SEQ ID NO: 1082 - RNA, 20 nt, Artificial Sequence
  synthesized
cucugcacacagauguaaca

SEQ ID NO: 1083 - RNA, 20 nt, Artificial Sequence
  synthesized
cugcacacagauggaacagu

SEQ ID NO: 1084 - RNA, 20 nt, Artificial Sequence
  synthesized
cugcacacagauguaacagu

SEQ ID NO: 1085 - RNA, 20 nt, Artificial Sequence
  synthesized
gaaaacacagacuguuacau

SEQ ID NO: 1086 - RNA, 20 nt, Artificial Sequence
  synthesized
gaaaacacagacuguuccau

SEQ ID NO: 1087 - RNA, 20 nt, Artificial Sequence
  synthesized
gaacagucuguguuuuccug

SEQ ID NO: 1088 - RNA, 20 nt, Artificial Sequence
  synthesized
gacuguuacaucugugugca

SEQ ID NO: 1089 - RNA, 20 nt, Artificial Sequence
  synthesized
gacuguuccaucugugugca

SEQ ID NO: 1090 - RNA, 20 nt, Artificial Sequence
  synthesized
gcacacagauggaacagucu

SEQ ID NO: 1091 - RNA, 20 nt, Artificial Sequence
  synthesized
gcacacagauguaacagucu

SEQ ID NO: 1092 - RNA, 20 nt, Artificial Sequence
  synthesized
ggaaaacacagacuguuaca

SEQ ID NO: 1093 - RNA, 20 nt, Artificial Sequence
  synthesized
ggaaaacacagacuguucca

SEQ ID NO: 1094 - RNA, 20 nt, Artificial Sequence
  synthesized
ggaacagucuguguuuuccu

SEQ ID NO: 1095 - RNA, 20 nt, Artificial Sequence
  synthesized
guaacagucuguguuuuccu

SEQ ID NO: 1096 - RNA, 20 nt, Artificial Sequence
  synthesized
uaacagucuguguuuuccug

SEQ ID NO: 1097 - RNA, 20 nt, Artificial Sequence
  synthesized
ucugcacacagauggaacag

SEQ ID NO: 1098 - RNA, 20 nt, Artificial Sequence
  synthesized
ucugcacacagauguaacag

SEQ ID NO: 1099 - RNA, 20 nt, Artificial Sequence
  synthesized
uuccaucugugugcagaggg

SEQ ID NO: 1100 - RNA, 20 nt, Artificial Sequence
  synthesized
aaggcaggggcagcaugcau

SEQ ID NO: 1101 - RNA, 20 nt, Artificial Sequence
  synthesized
aaggcaggggcagcauguau

SEQ ID NO: 1102 - RNA, 20 nt, Artificial Sequence
  synthesized
acggccauacaugcugcccc

SEQ ID NO: 1103 - RNA, 20 nt, Artificial Sequence
  synthesized
acggccaugcaugcugcccc

SEQ ID NO: 1104 - RNA, 20 nt, Artificial Sequence
  synthesized
agcaugcauggccgugaaga

SEQ ID NO: 1105 - RNA, 20 nt, Artificial Sequence
  synthesized
agcauguauggccgugaaga

SEQ ID NO: 1106 - RNA, 20 nt, Artificial Sequence
  synthesized
aggcaggggcagcaugcaug

SEQ ID NO: 1107 - RNA, 20 nt, Artificial Sequence
  synthesized
aggcaggggcagcauguaug

SEQ ID NO: 1108 - RNA, 20 nt, Artificial Sequence
  synthesized
auacaugcugccccugccuu

SEQ ID NO: 1109 - RNA, 20 nt, Artificial Sequence
  synthesized
augcaugcugccccugccuu

SEQ ID NO: 1110 - RNA, 20 nt, Artificial Sequence
  synthesized
cacggccauacaugcugccc

SEQ ID NO: 1111 - RNA, 20 nt, Artificial Sequence
  synthesized
cacggccaugcaugcugccc

SEQ ID NO: 1112 - RNA, 20 nt, Artificial Sequence
  synthesized
cagcaugcauggccgugaag

SEQ ID NO: 1113 - RNA, 20 nt, Artificial Sequence
  synthesized
cagcauguauggccgugaag

SEQ ID NO: 1114 - RNA, 20 nt, Artificial Sequence
  synthesized
caggggcagcaugcauggcc

SEQ ID NO: 1115 - RNA, 20 nt, Artificial Sequence
  synthesized
caggggcagcauguauggcc

SEQ ID NO: 1116 - RNA, 20 nt, Artificial Sequence
  synthesized
cauacaugcugccccugccu

SEQ ID NO: 1117 - RNA, 20 nt, Artificial Sequence
  synthesized
caugcaugcugccccugccu

SEQ ID NO: 1118 - RNA, 20 nt, Artificial Sequence
  synthesized
cauggccgugaagaccacgg

SEQ ID NO: 1119 - RNA, 20 nt, Artificial Sequence
  synthesized
ccauacaugcugccccugcc

SEQ ID NO: 1120 - RNA, 20 nt, Artificial Sequence
  synthesized
ccaugcaugcugccccugcc

SEQ ID NO: 1121 - RNA, 20 nt, Artificial Sequence
  synthesized
ccguggucuucacggccaua

SEQ ID NO: 1122 - RNA, 20 nt, Artificial Sequence
  synthesized
ccguggucuucacggccaug

SEQ ID NO: 1123 - RNA, 20 nt, Artificial Sequence
  synthesized
cggccauacaugcugccccu

SEQ ID NO: 1124 - RNA, 20 nt, Artificial Sequence
  synthesized
cggccaugcaugcugccccu

SEQ ID NO: 1125 - RNA, 20 nt, Artificial Sequence
  synthesized
cguggucuucacggccauac

SEQ ID NO: 1126 - RNA, 20 nt, Artificial Sequence
  synthesized
cguggucuucacggccaugc

SEQ ID NO: 1127 - RNA, 20 nt, Artificial Sequence
  synthesized
cuucacggccauacaugcug

SEQ ID NO: 1128 - RNA, 20 nt, Artificial Sequence
  synthesized
cuucacggccaugcaugcug

SEQ ID NO: 1129 - RNA, 20 nt, Artificial Sequence
  synthesized
gcagcaugcauggccgugaa

SEQ ID NO: 1130 - RNA, 20 nt, Artificial Sequence
  synthesized
gcagcauguauggccgugaa

SEQ ID NO: 1131 - RNA, 20 nt, Artificial Sequence
  synthesized
gcaugcauggccgugaagac

SEQ ID NO: 1132 - RNA, 20 nt, Artificial Sequence
  synthesized
gcauguauggccgugaagac

SEQ ID NO: 1133 - RNA, 20 nt, Artificial Sequence
  synthesized
gccauacaugcugccccugc

SEQ ID NO: 1134 - RNA, 20 nt, Artificial Sequence
  synthesized
gccaugcaugcugccccugc

SEQ ID NO: 1135 - RNA, 20 nt, Artificial Sequence
  synthesized
ggaaggcaggggcagcaugc

SEQ ID NO: 1136 - RNA, 20 nt, Artificial Sequence
  synthesized
ggaaggcaggggcagcaugu

SEQ ID NO: 1137 - RNA, 20 nt, Artificial Sequence
  synthesized
ggcaggggcagcaugcaugg

SEQ ID NO: 1138 - RNA, 20 nt, Artificial Sequence
  synthesized
ggcaggggcagcauguaugg

SEQ ID NO: 1139 - RNA, 20 nt, Artificial Sequence
  synthesized
ggccauacaugcugccccug

SEQ ID NO: 1140 - RNA, 20 nt, Artificial Sequence
  synthesized
ggccaugcaugcugccccug

SEQ ID NO: 1141 - RNA, 20 nt, Artificial Sequence
  synthesized
gggcagcaugcauggccgug

SEQ ID NO: 1142 - RNA, 20 nt, Artificial Sequence
  synthesized
gggcagcauguauggccgug

SEQ ID NO: 1143 - RNA, 20 nt, Artificial Sequence
  synthesized
ggucuucacggccauacaug

SEQ ID NO: 1144 - RNA, 20 nt, Artificial Sequence
  synthesized
ggucuucacggccaugcaug

SEQ ID NO: 1145 - RNA, 20 nt, Artificial Sequence
  synthesized
guauggccgugaagaccacg

SEQ ID NO: 1146 - RNA, 20 nt, Artificial Sequence
  synthesized
gucuucacggccauacaugc

SEQ ID NO: 1147 - RNA, 20 nt, Artificial Sequence
  synthesized
gucuucacggccaugcaugc

SEQ ID NO: 1148 - RNA, 20 nt, Artificial Sequence
  synthesized
guggucuucacggccauaca

SEQ ID NO: 1149 - RNA, 20 nt, Artificial Sequence
  synthesized
guggucuucacggccaugca

SEQ ID NO: 1150 - RNA, 20 nt, Artificial Sequence
  synthesized
uacaugcugccccugccuuc

SEQ ID NO: 1151 - RNA, 20 nt, Artificial Sequence
  synthesized
uauggccgugaagaccacgg

SEQ ID NO: 1152 - RNA, 20 nt, Artificial Sequence
  synthesized
ucacggccauacaugcugcc

SEQ ID NO: 1153 - RNA, 20 nt, Artificial Sequence
  synthesized
ucacggccaugcaugcugcc

SEQ ID NO: 1154 - RNA, 20 nt, Artificial Sequence
  synthesized
ucuucacggccauacaugcu

SEQ ID NO: 1155 - RNA, 20 nt, Artificial Sequence
  synthesized
ucuucacggccaugcaugcu

SEQ ID NO: 1156 - RNA, 20 nt, Artificial Sequence
  synthesized
ugcaugcugccccugccuuc

SEQ ID NO: 1157 - RNA, 20 nt, Artificial Sequence
  synthesized
uggucuucacggccauacau

SEQ ID NO: 1158 - RNA, 20 nt, Artificial Sequence
  synthesized
uggucuucacggccaugcau

SEQ ID NO: 1159 - RNA, 20 nt, Artificial Sequence
  synthesized
uucacggccauacaugcugc

SEQ ID NO: 1160 - RNA, 20 nt, Artificial Sequence
  synthesized
uucacggccaugcaugcugc

SEQ ID NO: 1161 - RNA, 20 nt, Artificial Sequence
  synthesized
aagggcuguuguccccugag

SEQ ID NO: 1162 - RNA, 20 nt, Artificial Sequence
  synthesized
aagggcuguuguucccugag

SEQ ID NO: 1163 - RNA, 20 nt, Artificial Sequence
  synthesized
aggaagggcuguuguccccu

SEQ ID NO: 1164 - RNA, 20 nt, Artificial Sequence
  synthesized
aggaagggcuguuguucccu

SEQ ID NO: 1165 - RNA, 20 nt, Artificial Sequence
  synthesized
agggcuguuguccccugaga

SEQ ID NO: 1166 - RNA, 20 nt, Artificial Sequence
  synthesized
agggcuguuguucccugaga

SEQ ID NO: 1167 - RNA, 20 nt, Artificial Sequence
  synthesized
cagggaacaacagcccuucc

SEQ ID NO: 1168 - RNA, 20 nt, Artificial Sequence
  synthesized
caggggacaacagcccuucc

SEQ ID NO: 1169 - RNA, 20 nt, Artificial Sequence
  synthesized
ccccugagacccccaccuag

SEQ ID NO: 1170 - RNA, 20 nt, Artificial Sequence
  synthesized
ccgaggaagggcuguugucc

SEQ ID NO: 1171 - RNA, 20 nt, Artificial Sequence
  synthesized
ccgaggaagggcuguuguuc

SEQ ID NO: 1172 - RNA, 20 nt, Artificial Sequence
  synthesized
cgaggaagggcuguuguccc

SEQ ID NO: 1173 - RNA, 20 nt, Artificial Sequence
  synthesized
cgaggaagggcuguuguucc

SEQ ID NO: 1174 - RNA, 20 nt, Artificial Sequence
  synthesized
cuaggugggggucucaggga

SEQ ID NO: 1175 - RNA, 20 nt, Artificial Sequence
  synthesized
cuaggugggggucucagggg

SEQ ID NO: 1176 - RNA, 20 nt, Artificial Sequence
  synthesized
cucagggaacaacagcccuu

SEQ ID NO: 1177 - RNA, 20 nt, Artificial Sequence
  synthesized
cucaggggacaacagcccuu

SEQ ID NO: 1178 - RNA, 20 nt, Artificial Sequence
  synthesized
cuguuguccccugagacccc

SEQ ID NO: 1179 - RNA, 20 nt, Artificial Sequence
  synthesized
cuguuguucccugagacccc

SEQ ID NO: 1180 - RNA, 20 nt, Artificial Sequence
  synthesized
gaagggcuguuguucccuga

SEQ ID NO: 1181 - RNA, 20 nt, Artificial Sequence
  synthesized
gacaacagcccuuccucggc

SEQ ID NO: 1182 - RNA, 20 nt, Artificial Sequence
  synthesized
gccgaggaagggcuguuguc

SEQ ID NO: 1183 - RNA, 20 nt, Artificial Sequence
  synthesized
gccgaggaagggcuguuguu

SEQ ID NO: 1184 - RNA, 20 nt, Artificial Sequence
  synthesized
gcuguuguccccugagaccc

SEQ ID NO: 1185 - RNA, 20 nt, Artificial Sequence
  synthesized
gcuguuguucccugagaccc

SEQ ID NO: 1186 - RNA, 20 nt, Artificial Sequence
  synthesized
ggaacaacagcccuuccucg

SEQ ID NO: 1187 - RNA, 20 nt, Artificial Sequence
  synthesized
ggacaacagcccuuccucgg

SEQ ID NO: 1188 - RNA, 20 nt, Artificial Sequence
  synthesized
ggcuguuguccccugagacc

SEQ ID NO: 1189 - RNA, 20 nt, Artificial Sequence
  synthesized
ggcuguuguucccugagacc

SEQ ID NO: 1190 - RNA, 20 nt, Artificial Sequence
  synthesized
gggaacaacagcccuuccuc

SEQ ID NO: 1191 - RNA, 20 nt, Artificial Sequence
  synthesized
gggacaacagcccuuccucg

SEQ ID NO: 1192 - RNA, 20 nt, Artificial Sequence
  synthesized
ggggacaacagcccuuccuc

SEQ ID NO: 1193 - RNA, 20 nt, Artificial Sequence
  synthesized
gggggucucagggaacaaca

SEQ ID NO: 1194 - RNA, 20 nt, Artificial Sequence
  synthesized
gggggucucaggggacaaca

SEQ ID NO: 1195 - RNA, 20 nt, Artificial Sequence
  synthesized
ggggucucagggaacaacag

SEQ ID NO: 1196 - RNA, 20 nt, Artificial Sequence
  synthesized
ggggucucaggggacaacag

SEQ ID NO: 1197 - RNA, 20 nt, Artificial Sequence
  synthesized
gggucucagggaacaacagc

SEQ ID NO: 1198 - RNA, 20 nt, Artificial Sequence
  synthesized
gggucucaggggacaacagc

SEQ ID NO: 1199 - RNA, 20 nt, Artificial Sequence
  synthesized
ggucucagggaacaacagcc

SEQ ID NO: 1200 - RNA, 20 nt, Artificial Sequence
  synthesized
ggugggggucucagggaaca

SEQ ID NO: 1201 - RNA, 20 nt, Artificial Sequence
  synthesized
ggugggggucucaggggaca

SEQ ID NO: 1202 - RNA, 20 nt, Artificial Sequence
  synthesized
guccccugagacccccaccu

SEQ ID NO: 1203 - RNA, 20 nt, Artificial Sequence
  synthesized
gucucagggaacaacagccc

SEQ ID NO: 1204 - RNA, 20 nt, Artificial Sequence
  synthesized
gugggggucucagggaacaa

SEQ ID NO: 1205 - RNA, 20 nt, Artificial Sequence
  synthesized
gugggggucucaggggacaa

SEQ ID NO: 1206 - RNA, 20 nt, Artificial Sequence
  synthesized
guucccugagacccccaccu

SEQ ID NO: 1207 - RNA, 20 nt, Artificial Sequence
  synthesized
uaggugggggucucagggaa

SEQ ID NO: 1208 - RNA, 20 nt, Artificial Sequence
  synthesized
uaggugggggucucagggga

SEQ ID NO: 1209 - RNA, 20 nt, Artificial Sequence
  synthesized
ucagggaacaacagcccuuc

SEQ ID NO: 1210 - RNA, 20 nt, Artificial Sequence
  synthesized
ucaggggacaacagcccuuc

SEQ ID NO: 1211 - RNA, 20 nt, Artificial Sequence
  synthesized
uccccugagacccccaccua

SEQ ID NO: 1212 - RNA, 20 nt, Artificial Sequence
  synthesized
ucccugagacccccaccuag

SEQ ID NO: 1213 - RNA, 20 nt, Artificial Sequence
  synthesized
ucucagggaacaacagcccu

SEQ ID NO: 1214 - RNA, 20 nt, Artificial Sequence
  synthesized
ucucaggggacaacagcccu

SEQ ID NO: 1215 - RNA, 20 nt, Artificial Sequence
  synthesized
ugggggucucagggaacaac

SEQ ID NO: 1216 - RNA, 20 nt, Artificial Sequence
  synthesized
ugggggucucaggggacaac

SEQ ID NO: 1217 - RNA, 20 nt, Artificial Sequence
  synthesized
uguccccugagacccccacc

SEQ ID NO: 1218 - RNA, 20 nt, Artificial Sequence
  synthesized
uguucccugagacccccacc

SEQ ID NO: 1219 - RNA, 20 nt, Artificial Sequence
  synthesized
uguuguccccugagaccccc

SEQ ID NO: 1220 - RNA, 20 nt, Artificial Sequence
  synthesized
uguuguucccugagaccccc

SEQ ID NO: 1221 - RNA, 20 nt, Artificial Sequence
  synthesized
uucccugagacccccaccua

SEQ ID NO: 1222 - RNA, 20 nt, Artificial Sequence
  synthesized
uuguccccugagacccccac

SEQ ID NO: 1223 - RNA, 20 nt, Artificial Sequence
  synthesized
uuguucccugagacccccac

SEQ ID NO: 1224 - RNA, 20 nt, Artificial Sequence
  synthesized
aaaaguucuuacauaagcag

SEQ ID NO: 1225 - RNA, 20 nt, Artificial Sequence
  synthesized
aaaguucuuacauaagcagc

SEQ ID NO: 1226 - RNA, 20 nt, Artificial Sequence
  synthesized
aagcagccaaccccugggca

SEQ ID NO: 1227 - RNA, 20 nt, Artificial Sequence
  synthesized
aagcggccaaccccugggca

SEQ ID NO: 1228 - RNA, 20 nt, Artificial Sequence
  synthesized
aaguucuuacauaagcagcc

SEQ ID NO: 1229 - RNA, 20 nt, Artificial Sequence
  synthesized
acauaagcagccaaccccug

SEQ ID NO: 1230 - RNA, 20 nt, Artificial Sequence
  synthesized
agcagccaaccccugggcag

SEQ ID NO: 1231 - RNA, 20 nt, Artificial Sequence
  synthesized
agccaaccccugggcagagc

SEQ ID NO: 1232 - RNA, 20 nt, Artificial Sequence
  synthesized
agcggccaaccccugggcag

SEQ ID NO: 1233 - RNA, 20 nt, Artificial Sequence
  synthesized
aguucuuacauaagcagcca

SEQ ID NO: 1234 - RNA, 20 nt, Artificial Sequence
  synthesized
auaagcagccaaccccuggg

SEQ ID NO: 1235 - RNA, 20 nt, Artificial Sequence
  synthesized
auaagcggccaaccccuggg

SEQ ID NO: 1236 - RNA, 20 nt, Artificial Sequence
  synthesized
cagggguuggcugcuuaugu

SEQ ID NO: 1237 - RNA, 20 nt, Artificial Sequence
  synthesized
cauaagcagccaaccccugg

SEQ ID NO: 1238 - RNA, 20 nt, Artificial Sequence
  synthesized
cauaagcggccaaccccugg

SEQ ID NO: 1239 - RNA, 20 nt, Artificial Sequence
  synthesized
ccagggguuggcugcuuaug

SEQ ID NO: 1240 - RNA, 20 nt, Artificial Sequence
  synthesized
cccagggguuggcugcuuau

SEQ ID NO: 1241 - RNA, 20 nt, Artificial Sequence
  synthesized
cggccaaccccugggcagag

SEQ ID NO: 1242 - RNA, 20 nt, Artificial Sequence
  synthesized
cucugcccagggguuggccg

SEQ ID NO: 1243 - RNA, 20 nt, Artificial Sequence
  synthesized
cucugcccagggguuggcug

SEQ ID NO: 1244 - RNA, 20 nt, Artificial Sequence
  synthesized
cugcccagggguuggccgcu

SEQ ID NO: 1245 - RNA, 20 nt, Artificial Sequence
  synthesized
cugcccagggguuggcugcu

SEQ ID NO: 1246 - RNA, 20 nt, Artificial Sequence
  synthesized
cugcuuauguaagaacuuuu

SEQ ID NO: 1247 - RNA, 20 nt, Artificial Sequence
  synthesized
gcagccaaccccugggcaga

SEQ ID NO: 1248 - RNA, 20 nt, Artificial Sequence
  synthesized
gcccagggguuggcugcuua

SEQ ID NO: 1249 - RNA, 20 nt, Artificial Sequence
  synthesized
gcggccaaccccugggcaga

SEQ ID NO: 1250 - RNA, 20 nt, Artificial Sequence
  synthesized
gcucugcccagggguuggcc

SEQ ID NO: 1251 - RNA, 20 nt, Artificial Sequence
  synthesized
gcucugcccagggguuggcu

SEQ ID NO: 1252 - RNA, 20 nt, Artificial Sequence
  synthesized
gcugcuuauguaagaacuuu

SEQ ID NO: 1253 - RNA, 20 nt, Artificial Sequence
  synthesized
ggccaaccccugggcagagc

SEQ ID NO: 1254 - RNA, 20 nt, Artificial Sequence
  synthesized
ggcugcuuauguaagaacuu

SEQ ID NO: 1255 - RNA, 20 nt, Artificial Sequence
  synthesized
gggguuggcugcuuauguaa

SEQ ID NO: 1256 - RNA, 20 nt, Artificial Sequence
  synthesized
ggguuggcugcuuauguaag

SEQ ID NO: 1257 - RNA, 20 nt, Artificial Sequence
  synthesized
gguuggcugcuuauguaaga

SEQ ID NO: 1258 - RNA, 20 nt, Artificial Sequence
  synthesized
guucuuacauaagcagccaa

SEQ ID NO: 1259 - RNA, 20 nt, Artificial Sequence
  synthesized
guuggcugcuuauguaagaa

SEQ ID NO: 1260 - RNA, 20 nt, Artificial Sequence
  synthesized
ucugcccagggguuggccgc

SEQ ID NO: 1261 - RNA, 20 nt, Artificial Sequence
  synthesized
ucugcccagggguuggcugc

SEQ ID NO: 1262 - RNA, 20 nt, Artificial Sequence
  synthesized
ucuuacauaagcagccaacc

SEQ ID NO: 1263 - RNA, 20 nt, Artificial Sequence
  synthesized
ugcccagggguuggcugcuu

SEQ ID NO: 1264 - RNA, 20 nt, Artificial Sequence
  synthesized
uggcugcuuauguaagaacu

SEQ ID NO: 1265 - RNA, 20 nt, Artificial Sequence
  synthesized
uucuuacauaagcagccaac

SEQ ID NO: 1266 - RNA, 20 nt, Artificial Sequence
  synthesized
uuggcugcuuauguaagaac

SEQ ID NO: 1267 - RNA, 20 nt, Artificial Sequence
  synthesized
acccugcgcgaucuucacuu

SEQ ID NO: 1268 - RNA, 20 nt, Artificial Sequence
  synthesized
cacccugcgcgaucuucacu

SEQ ID NO: 1269 - RNA, 20 nt, Artificial Sequence
  synthesized
cccugcgcgaucuucacuuu

SEQ ID NO: 1270 - RNA, 20 nt, Artificial Sequence
  synthesized
cgcgaucuucacuuuauccc

SEQ ID NO: 1271 - RNA, 20 nt, Artificial Sequence
  synthesized
gcgcgaucuucacuuuaucc

SEQ ID NO: 1272 - RNA, 20 nt, Artificial Sequence
  synthesized
ugcgcgaucuucacuuuauc

SEQ ID NO: 1273 - RNA, 20 nt, Artificial Sequence
  synthesized
acaugucggucaccccaagg

SEQ ID NO: 1274 - RNA, 20 nt, Artificial Sequence
  synthesized
acaugucggucaccgcaagg

SEQ ID NO: 1275 - RNA, 20 nt, Artificial Sequence
  synthesized
accaggaccuugcggugacc

SEQ ID NO: 1276 - RNA, 20 nt, Artificial Sequence
  synthesized
accaggaccuuggggugacc

SEQ ID NO: 1277 - RNA, 20 nt, Artificial Sequence
  synthesized
accccaagguccuggugcaa

SEQ ID NO: 1278 - RNA, 20 nt, Artificial Sequence
  synthesized
accgcaagguccuggugcaa

SEQ ID NO: 1279 - RNA, 20 nt, Artificial Sequence
  synthesized
accuugcggugaccgacaug

SEQ ID NO: 1280 - RNA, 20 nt, Artificial Sequence
  synthesized
accuuggggugaccgacaug

SEQ ID NO: 1281 - RNA, 20 nt, Artificial Sequence
  synthesized
aggaccuugcggugaccgac

SEQ ID NO: 1282 - RNA, 20 nt, Artificial Sequence
  synthesized
aggaccuuggggugaccgac

SEQ ID NO: 1283 - RNA, 20 nt, Artificial Sequence
  synthesized
agugacaugucggucacccc

SEQ ID NO: 1284 - RNA, 20 nt, Artificial Sequence
  synthesized
agugacaugucggucaccgc

SEQ ID NO: 1285 - RNA, 20 nt, Artificial Sequence
  synthesized
augucggucaccccaagguc

SEQ ID NO: 1286 - RNA, 20 nt, Artificial Sequence
  synthesized
augucggucaccgcaagguc

SEQ ID NO: 1287 - RNA, 20 nt, Artificial Sequence
  synthesized
auguugcaccaggaccuugc

SEQ ID NO: 1288 - RNA, 20 nt, Artificial Sequence
  synthesized
auguugcaccaggaccuugg

SEQ ID NO: 1289 - RNA, 20 nt, Artificial Sequence
  synthesized
caccaggaccuugcggugac

SEQ ID NO: 1290 - RNA, 20 nt, Artificial Sequence
  synthesized
caccaggaccuuggggugac

SEQ ID NO: 1291 - RNA, 20 nt, Artificial Sequence
  synthesized
caccccaagguccuggugca

SEQ ID NO: 1292 - RNA, 20 nt, Artificial Sequence
  synthesized
caccgcaagguccuggugca

SEQ ID NO: 1293 - RNA, 20 nt, Artificial Sequence
  synthesized
caggaccuugcggugaccga

SEQ ID NO: 1294 - RNA, 20 nt, Artificial Sequence
  synthesized
caggaccuuggggugaccga

SEQ ID NO: 1295 - RNA, 20 nt, Artificial Sequence
  synthesized
caugucggucaccccaaggu

SEQ ID NO: 1296 - RNA, 20 nt, Artificial Sequence
  synthesized
caugucggucaccgcaaggu

SEQ ID NO: 1297 - RNA, 20 nt, Artificial Sequence
  synthesized
ccaagguccuggugcaacau

SEQ ID NO: 1298 - RNA, 20 nt, Artificial Sequence
  synthesized
ccaggaccuugcggugaccg

SEQ ID NO: 1299 - RNA, 20 nt, Artificial Sequence
  synthesized
ccaggaccuuggggugaccg

SEQ ID NO: 1300 - RNA, 20 nt, Artificial Sequence
  synthesized
cccaagguccuggugcaaca

SEQ ID NO: 1301 - RNA, 20 nt, Artificial Sequence
  synthesized
ccccaagguccuggugcaac

SEQ ID NO: 1302 - RNA, 20 nt, Artificial Sequence
  synthesized
ccgcaagguccuggugcaac

SEQ ID NO: 1303 - RNA, 20 nt, Artificial Sequence
  synthesized
ccuugcggugaccgacaugu

SEQ ID NO: 1304 - RNA, 20 nt, Artificial Sequence
  synthesized
ccuuggggugaccgacaugu

SEQ ID NO: 1305 - RNA, 20 nt, Artificial Sequence
  synthesized
cgcaagguccuggugcaaca

SEQ ID NO: 1306 - RNA, 20 nt, Artificial Sequence
  synthesized
cggucaccccaagguccugg

SEQ ID NO: 1307 - RNA, 20 nt, Artificial Sequence
  synthesized
cggucaccgcaagguccugg

SEQ ID NO: 1308 - RNA, 20 nt, Artificial Sequence
  synthesized
cggugaccgacaugucacuc

SEQ ID NO: 1309 - RNA, 20 nt, Artificial Sequence
  synthesized
cuugcggugaccgacauguc

SEQ ID NO: 1310 - RNA, 20 nt, Artificial Sequence
  synthesized
cuuggggugaccgacauguc

SEQ ID NO: 1311 - RNA, 20 nt, Artificial Sequence
  synthesized
gacaugucggucaccccaag

SEQ ID NO: 1312 - RNA, 20 nt, Artificial Sequence
  synthesized
gacaugucggucaccgcaag

SEQ ID NO: 1313 - RNA, 20 nt, Artificial Sequence
  synthesized
gaccuugcggugaccgacau

SEQ ID NO: 1314 - RNA, 20 nt, Artificial Sequence
  synthesized
gaccuuggggugaccgacau

SEQ ID NO: 1315 - RNA, 20 nt, Artificial Sequence
  synthesized
gagugacaugucggucaccc

SEQ ID NO: 1316 - RNA, 20 nt, Artificial Sequence
  synthesized
gagugacaugucggucaccg

SEQ ID NO: 1317 - RNA, 20 nt, Artificial Sequence
  synthesized
gcaagguccuggugcaacau

SEQ ID NO: 1318 - RNA, 20 nt, Artificial Sequence
  synthesized
gcaccaggaccuugcgguga

SEQ ID NO: 1319 - RNA, 20 nt, Artificial Sequence
  synthesized
gcaccaggaccuugggguga

SEQ ID NO: 1320 - RNA, 20 nt, Artificial Sequence
  synthesized
gcggugaccgacaugucacu

SEQ ID NO: 1321 - RNA, 20 nt, Artificial Sequence
  synthesized
ggaccuugcggugaccgaca

SEQ ID NO: 1322 - RNA, 20 nt, Artificial Sequence
  synthesized
ggaccuuggggugaccgaca

SEQ ID NO: 1323 - RNA, 20 nt, Artificial Sequence
  synthesized
ggggugaccgacaugucacu

SEQ ID NO: 1324 - RNA, 20 nt, Artificial Sequence
  synthesized
gggugaccgacaugucacuc

SEQ ID NO: 1325 - RNA, 20 nt, Artificial Sequence
  synthesized
ggucaccccaagguccuggu

SEQ ID NO: 1326 - RNA, 20 nt, Artificial Sequence
  synthesized
ggucaccgcaagguccuggu

SEQ ID NO: 1327 - RNA, 20 nt, Artificial Sequence
  synthesized
gucaccccaagguccuggug

SEQ ID NO: 1328 - RNA, 20 nt, Artificial Sequence
  synthesized
gucaccgcaagguccuggug

SEQ ID NO: 1329 - RNA, 20 nt, Artificial Sequence
  synthesized
gucggucaccccaagguccu

SEQ ID NO: 1330 - RNA, 20 nt, Artificial Sequence
  synthesized
gucggucaccgcaagguccu

SEQ ID NO: 1331 - RNA, 20 nt, Artificial Sequence
  synthesized
gugacaugucggucacccca

SEQ ID NO: 1332 - RNA, 20 nt, Artificial Sequence
  synthesized
gugacaugucggucaccgca

SEQ ID NO: 1333 - RNA, 20 nt, Artificial Sequence
  synthesized
guugcaccaggaccuugcgg

SEQ ID NO: 1334 - RNA, 20 nt, Artificial Sequence
  synthesized
guugcaccaggaccuugggg

SEQ ID NO: 1335 - RNA, 20 nt, Artificial Sequence
  synthesized
ucaccccaagguccuggugc

SEQ ID NO: 1336 - RNA, 20 nt, Artificial Sequence
  synthesized
ucaccgcaagguccuggugc

SEQ ID NO: 1337 - RNA, 20 nt, Artificial Sequence
  synthesized
ucggucaccccaagguccug

SEQ ID NO: 1338 - RNA, 20 nt, Artificial Sequence
  synthesized
ucggucaccgcaagguccug

SEQ ID NO: 1339 - RNA, 20 nt, Artificial Sequence
  synthesized
ugacaugucggucaccccaa

SEQ ID NO: 1340 - RNA, 20 nt, Artificial Sequence
  synthesized
ugacaugucggucaccgcaa

SEQ ID NO: 1341 - RNA, 20 nt, Artificial Sequence
  synthesized
ugcaccaggaccuugcggug

SEQ ID NO: 1342 - RNA, 20 nt, Artificial Sequence
  synthesized
ugcaccaggaccuuggggug

SEQ ID NO: 1343 - RNA, 20 nt, Artificial Sequence
  synthesized
ugcggugaccgacaugucac

SEQ ID NO: 1344 - RNA, 20 nt, Artificial Sequence
  synthesized
uggggugaccgacaugucac

SEQ ID NO: 1345 - RNA, 20 nt, Artificial Sequence
  synthesized
ugucggucaccccaaggucc

SEQ ID NO: 1346 - RNA, 20 nt, Artificial Sequence
  synthesized
ugucggucaccgcaaggucc

SEQ ID NO: 1347 - RNA, 20 nt, Artificial Sequence
  synthesized
uguugcaccaggaccuugcg

SEQ ID NO: 1348 - RNA, 20 nt, Artificial Sequence
  synthesized
uguugcaccaggaccuuggg

SEQ ID NO: 1349 - RNA, 20 nt, Artificial Sequence
  synthesized
uugcaccaggaccuugcggu

SEQ ID NO: 1350 - RNA, 20 nt, Artificial Sequence
  synthesized
uugcaccaggaccuuggggu

SEQ ID NO: 1351 - RNA, 20 nt, Artificial Sequence
  synthesized
uugcggugaccgacauguca

SEQ ID NO: 1352 - RNA, 20 nt, Artificial Sequence
  synthesized
uuggggugaccgacauguca

SEQ ID NO: 1353 - RNA, 20 nt, Artificial Sequence
  synthesized
aaaucuccauaauuucacug

SEQ ID NO: 1354 - RNA, 20 nt, Artificial Sequence
  synthesized
aagccaguaaaauuauggag

SEQ ID NO: 1355 - RNA, 20 nt, Artificial Sequence
  synthesized
aagccagugaaauuauggag

SEQ ID NO: 1356 - RNA, 20 nt, Artificial Sequence
  synthesized
aaucuccauaauuucacugg

SEQ ID NO: 1357 - RNA, 20 nt, Artificial Sequence
  synthesized
aauuucacuggcuucuauca

SEQ ID NO: 1358 - RNA, 20 nt, Artificial Sequence
  synthesized
aauuuuacuggcuucuauca

SEQ ID NO: 1359 - RNA, 20 nt, Artificial Sequence
  synthesized
acaugauagaagccaguaaa

SEQ ID NO: 1360 - RNA, 20 nt, Artificial Sequence
  synthesized
acaugauagaagccagugaa

SEQ ID NO: 1361 - RNA, 20 nt, Artificial Sequence
  synthesized
agccaguaaaauuauggaga

SEQ ID NO: 1362 - RNA, 20 nt, Artificial Sequence
  synthesized
agccagugaaauuauggaga

SEQ ID NO: 1363 - RNA, 20 nt, Artificial Sequence
  synthesized
agugaaauuauggagauuug

SEQ ID NO: 1364 - RNA, 20 nt, Artificial Sequence
  synthesized
auaauuucacuggcuucuau

SEQ ID NO: 1365 - RNA, 20 nt, Artificial Sequence
  synthesized
aucuccauaauuucacuggc

SEQ ID NO: 1366 - RNA, 20 nt, Artificial Sequence
  synthesized
aucuccauaauuuuacuggc

SEQ ID NO: 1367 - RNA, 20 nt, Artificial Sequence
  synthesized
augauagaagccaguaaaau

SEQ ID NO: 1368 - RNA, 20 nt, Artificial Sequence
  synthesized
augauagaagccagugaaau

SEQ ID NO: 1369 - RNA, 20 nt, Artificial Sequence
  synthesized
auuucacuggcuucuaucau

SEQ ID NO: 1370 - RNA, 20 nt, Artificial Sequence
  synthesized
caaaucuccauaauuucacu

SEQ ID NO: 1371 - RNA, 20 nt, Artificial Sequence
  synthesized
cacuggcuucuaucaugucc

SEQ ID NO: 1372 - RNA, 20 nt, Artificial Sequence
  synthesized
cagugaaauuauggagauuu

SEQ ID NO: 1373 - RNA, 20 nt, Artificial Sequence
  synthesized
cauaauuucacuggcuucua

SEQ ID NO: 1374 - RNA, 20 nt, Artificial Sequence
  synthesized
cauaauuuuacuggcuucua

SEQ ID NO: 1375 - RNA, 20 nt, Artificial Sequence
  synthesized
caugauagaagccagugaaa

SEQ ID NO: 1376 - RNA, 20 nt, Artificial Sequence
  synthesized
ccauaauuucacuggcuucu

SEQ ID NO: 1377 - RNA, 20 nt, Artificial Sequence
  synthesized
ccauaauuuuacuggcuucu

SEQ ID NO: 1378 - RNA, 20 nt, Artificial Sequence
  synthesized
cuccauaauuucacuggcuu

SEQ ID NO: 1379 - RNA, 20 nt, Artificial Sequence
  synthesized
cuccauaauuuuacuggcuu

SEQ ID NO: 1380 - RNA, 20 nt, Artificial Sequence
  synthesized
gaagccagugaaauuaugga

SEQ ID NO: 1381 - RNA, 20 nt, Artificial Sequence
  synthesized
gacaugauagaagccaguaa

SEQ ID NO: 1382 - RNA, 20 nt, Artificial Sequence
  synthesized
gacaugauagaagccaguga

SEQ ID NO: 1383 - RNA, 20 nt, Artificial Sequence
  synthesized
gccaguaaaauuauggagau

SEQ ID NO: 1384 - RNA, 20 nt, Artificial Sequence
  synthesized
gccagugaaauuauggagau

SEQ ID NO: 1385 - RNA, 20 nt, Artificial Sequence
  synthesized
ggacaugauagaagccagug

SEQ ID NO: 1386 - RNA, 20 nt, Artificial Sequence
  synthesized
gugaaauuauggagauuuga

SEQ ID NO: 1387 - RNA, 20 nt, Artificial Sequence
  synthesized
uaauuucacuggcuucuauc

SEQ ID NO: 1388 - RNA, 20 nt, Artificial Sequence
  synthesized
uaauuuuacuggcuucuauc

SEQ ID NO: 1389 - RNA, 20 nt, Artificial Sequence
  synthesized
uacuggcuucuaucaugucc

SEQ ID NO: 1390 - RNA, 20 nt, Artificial Sequence
  synthesized
uagaagccaguaaaauuaug

SEQ ID NO: 1391 - RNA, 20 nt, Artificial Sequence
  synthesized
uagaagccagugaaauuaug

SEQ ID NO: 1392 - RNA, 20 nt, Artificial Sequence
  synthesized
ucacuggcuucuaucauguc

SEQ ID NO: 1393 - RNA, 20 nt, Artificial Sequence
  synthesized
uccauaauuucacuggcuuc

SEQ ID NO: 1394 - RNA, 20 nt, Artificial Sequence
  synthesized
uccauaauuuuacuggcuuc

SEQ ID NO: 1395 - RNA, 20 nt, Artificial Sequence
  synthesized
ucuccauaauuucacuggcu

SEQ ID NO: 1396 - RNA, 20 nt, Artificial Sequence
  synthesized
ucuccauaauuuuacuggcu

SEQ ID NO: 1397 - RNA, 20 nt, Artificial Sequence
  synthesized
ugauagaagccaguaaaauu

SEQ ID NO: 1398 - RNA, 20 nt, Artificial Sequence
  synthesized
ugauagaagccagugaaauu

SEQ ID NO: 1399 - RNA, 20 nt, Artificial Sequence
  synthesized
uuacuggcuucuaucauguc

SEQ ID NO: 1400 - RNA, 20 nt, Artificial Sequence
  synthesized
uucacuggcuucuaucaugu

SEQ ID NO: 1401 - RNA, 20 nt, Artificial Sequence
  synthesized
uuuacuggcuucuaucaugu

SEQ ID NO: 1402 - RNA, 20 nt, Artificial Sequence
  synthesized
uuucacuggcuucuaucaug

SEQ ID NO: 1403 - RNA, 20 nt, Artificial Sequence
  synthesized
uuuuacuggcuucuaucaug

SEQ ID NO: 1404 - RNA, 20 nt, Artificial Sequence
  synthesized
aaagcuguccaucaaaggua

SEQ ID NO: 1405 - RNA, 20 nt, Artificial Sequence
  synthesized
aaagcuguccaucgaaggua

SEQ ID NO: 1406 - RNA, 20 nt, Artificial Sequence
  synthesized
aaagguacagauaccacuca

SEQ ID NO: 1407 - RNA, 20 nt, Artificial Sequence
  synthesized
aagcuguccaucaaagguac

SEQ ID NO: 1408 - RNA, 20 nt, Artificial Sequence
  synthesized
aagcuguccaucgaagguac

SEQ ID NO: 1409 - RNA, 20 nt, Artificial Sequence
  synthesized
acaaagcuguccaucaaagg

SEQ ID NO: 1410 - RNA, 20 nt, Artificial Sequence
  synthesized
acaaagcuguccaucgaagg

SEQ ID NO: 1411 - RNA, 20 nt, Artificial Sequence
  synthesized
accuucgauggacagcuuug

SEQ ID NO: 1412 - RNA, 20 nt, Artificial Sequence
  synthesized
accuuugauggacagcuuug

SEQ ID NO: 1413 - RNA, 20 nt, Artificial Sequence
  synthesized
agcuguccaucaaagguaca

SEQ ID NO: 1414 - RNA, 20 nt, Artificial Sequence
  synthesized
agcuguccaucgaagguaca

SEQ ID NO: 1415 - RNA, 20 nt, Artificial Sequence
  synthesized
agugguaucuguaccuucga

SEQ ID NO: 1416 - RNA, 20 nt, Artificial Sequence
  synthesized
agugguaucuguaccuuuga

SEQ ID NO: 1417 - RNA, 20 nt, Artificial Sequence
  synthesized
aucaaagguacagauaccac

SEQ ID NO: 1418 - RNA, 20 nt, Artificial Sequence
  synthesized
aucgaagguacagauaccac

SEQ ID NO: 1419 - RNA, 20 nt, Artificial Sequence
  synthesized
aucuguaccuucgauggaca

SEQ ID NO: 1420 - RNA, 20 nt, Artificial Sequence
  synthesized
aucuguaccuuugauggaca

SEQ ID NO: 1421 - RNA, 20 nt, Artificial Sequence
  synthesized
caaagcuguccaucaaaggu

SEQ ID NO: 1422 - RNA, 20 nt, Artificial Sequence
  synthesized
caaagcuguccaucgaaggu

SEQ ID NO: 1423 - RNA, 20 nt, Artificial Sequence
  synthesized
caaagguacagauaccacuc

SEQ ID NO: 1424 - RNA, 20 nt, Artificial Sequence
  synthesized
cacaaagcuguccaucaaag

SEQ ID NO: 1425 - RNA, 20 nt, Artificial Sequence
  synthesized
cacaaagcuguccaucgaag

SEQ ID NO: 1426 - RNA, 20 nt, Artificial Sequence
  synthesized
caucaaagguacagauacca

SEQ ID NO: 1427 - RNA, 20 nt, Artificial Sequence
  synthesized
caucgaagguacagauacca

SEQ ID NO: 1428 - RNA, 20 nt, Artificial Sequence
  synthesized
ccaucaaagguacagauacc

SEQ ID NO: 1429 - RNA, 20 nt, Artificial Sequence
  synthesized
ccaucgaagguacagauacc

SEQ ID NO: 1430 - RNA, 20 nt, Artificial Sequence
  synthesized
ccuucgauggacagcuuugu

SEQ ID NO: 1431 - RNA, 20 nt, Artificial Sequence
  synthesized
ccuuugauggacagcuuugu

SEQ ID NO: 1432 - RNA, 20 nt, Artificial Sequence
  synthesized
cgaagguacagauaccacuc

SEQ ID NO: 1433 - RNA, 20 nt, Artificial Sequence
  synthesized
cgauggacagcuuugugccc

SEQ ID NO: 1434 - RNA, 20 nt, Artificial Sequence
  synthesized
cuguaccuucgauggacagc

SEQ ID NO: 1435 - RNA, 20 nt, Artificial Sequence
  synthesized
cuguaccuuugauggacagc

SEQ ID NO: 1436 - RNA, 20 nt, Artificial Sequence
  synthesized
cuguccaucaaagguacaga

SEQ ID NO: 1437 - RNA, 20 nt, Artificial Sequence
  synthesized
cuguccaucgaagguacaga

SEQ ID NO: 1438 - RNA, 20 nt, Artificial Sequence
  synthesized
cuucgauggacagcuuugug

SEQ ID NO: 1439 - RNA, 20 nt, Artificial Sequence
  synthesized
cuuugauggacagcuuugug

SEQ ID NO: 1440 - RNA, 20 nt, Artificial Sequence
  synthesized
gaagguacagauaccacuca

SEQ ID NO: 1441 - RNA, 20 nt, Artificial Sequence
  synthesized
gagugguaucuguaccuucg

SEQ ID NO: 1442 - RNA, 20 nt, Artificial Sequence
  synthesized
gagugguaucuguaccuuug

SEQ ID NO: 1443 - RNA, 20 nt, Artificial Sequence
  synthesized
gcacaaagcuguccaucaaa

SEQ ID NO: 1444 - RNA, 20 nt, Artificial Sequence
  synthesized
gcacaaagcuguccaucgaa

SEQ ID NO: 1445 - RNA, 20 nt, Artificial Sequence
  synthesized
gcuguccaucaaagguacag

SEQ ID NO: 1446 - RNA, 20 nt, Artificial Sequence
  synthesized
gcuguccaucgaagguacag

SEQ ID NO: 1447 - RNA, 20 nt, Artificial Sequence
  synthesized
ggcacaaagcuguccaucaa

SEQ ID NO: 1448 - RNA, 20 nt, Artificial Sequence
  synthesized
ggcacaaagcuguccaucga

SEQ ID NO: 1449 - RNA, 20 nt, Artificial Sequence
  synthesized
gggcacaaagcuguccauca

SEQ ID NO: 1450 - RNA, 20 nt, Artificial Sequence
  synthesized
gggcacaaagcuguccaucg

SEQ ID NO: 1451 - RNA, 20 nt, Artificial Sequence
  synthesized
gguaucuguaccuucgaugg

SEQ ID NO: 1452 - RNA, 20 nt, Artificial Sequence
  synthesized
gguaucuguaccuuugaugg

SEQ ID NO: 1453 - RNA, 20 nt, Artificial Sequence
  synthesized
guaccuucgauggacagcuu

SEQ ID NO: 1454 - RNA, 20 nt, Artificial Sequence
  synthesized
guaccuuugauggacagcuu

SEQ ID NO: 1455 - RNA, 20 nt, Artificial Sequence
  synthesized
guaucuguaccuucgaugga

SEQ ID NO: 1456 - RNA, 20 nt, Artificial Sequence
  synthesized
guaucuguaccuuugaugga

SEQ ID NO: 1457 - RNA, 20 nt, Artificial Sequence
  synthesized
guccaucaaagguacagaua

SEQ ID NO: 1458 - RNA, 20 nt, Artificial Sequence
  synthesized
guccaucgaagguacagaua

SEQ ID NO: 1459 - RNA, 20 nt, Artificial Sequence
  synthesized
gugguaucuguaccuucgau

SEQ ID NO: 1460 - RNA, 20 nt, Artificial Sequence
  synthesized
gugguaucuguaccuuugau

SEQ ID NO: 1461 - RNA, 20 nt, Artificial Sequence
  synthesized
uaccuucgauggacagcuuu

SEQ ID NO: 1462 - RNA, 20 nt, Artificial Sequence
  synthesized
uaccuuugauggacagcuuu

SEQ ID NO: 1463 - RNA, 20 nt, Artificial Sequence
  synthesized
uaucuguaccuucgauggac

SEQ ID NO: 1464 - RNA, 20 nt, Artificial Sequence
  synthesized
uaucuguaccuuugauggac

SEQ ID NO: 1465 - RNA, 20 nt, Artificial Sequence
  synthesized
ucaaagguacagauaccacu

SEQ ID NO: 1466 - RNA, 20 nt, Artificial Sequence
  synthesized
uccaucaaagguacagauac

SEQ ID NO: 1467 - RNA, 20 nt, Artificial Sequence
  synthesized
uccaucgaagguacagauac

SEQ ID NO: 1468 - RNA, 20 nt, Artificial Sequence
  synthesized
ucgaagguacagauaccacu

SEQ ID NO: 1469 - RNA, 20 nt, Artificial Sequence
  synthesized
ucgauggacagcuuugugcc

SEQ ID NO: 1470 - RNA, 20 nt, Artificial Sequence
  synthesized
ucuguaccuucgauggacag

SEQ ID NO: 1471 - RNA, 20 nt, Artificial Sequence
  synthesized
ucuguaccuuugauggacag

SEQ ID NO: 1472 - RNA, 20 nt, Artificial Sequence
  synthesized
ugagugguaucuguaccuuc

SEQ ID NO: 1473 - RNA, 20 nt, Artificial Sequence
  synthesized
ugagugguaucuguaccuuu

SEQ ID NO: 1474 - RNA, 20 nt, Artificial Sequence
  synthesized
ugauggacagcuuugugccc

SEQ ID NO: 1475 - RNA, 20 nt, Artificial Sequence
  synthesized
ugguaucuguaccuucgaug

SEQ ID NO: 1476 - RNA, 20 nt, Artificial Sequence
  synthesized
ugguaucuguaccuuugaug

SEQ ID NO: 1477 - RNA, 20 nt, Artificial Sequence
  synthesized
uguaccuucgauggacagcu

SEQ ID NO: 1478 - RNA, 20 nt, Artificial Sequence
  synthesized
uguaccuuugauggacagcu

SEQ ID NO: 1479 - RNA, 20 nt, Artificial Sequence
  synthesized
uguccaucaaagguacagau

SEQ ID NO: 1480 - RNA, 20 nt, Artificial Sequence
  synthesized
uguccaucgaagguacagau

SEQ ID NO: 1481 - RNA, 20 nt, Artificial Sequence
  synthesized
uucgauggacagcuuugugc

SEQ ID NO: 1482 - RNA, 20 nt, Artificial Sequence
  synthesized
uugauggacagcuuugugcc

SEQ ID NO: 1483 - RNA, 20 nt, Artificial Sequence
  synthesized
uuugauggacagcuuugugc

SEQ ID NO: 1484 - RNA, 20 nt, Artificial Sequence
  synthesized
aacuucccaaucuugauggg

SEQ ID NO: 1485 - RNA, 20 nt, Artificial Sequence
  synthesized
aacuucucaaucuugauggg

SEQ ID NO: 1486 - RNA, 20 nt, Artificial Sequence
  synthesized
agaaguuuucaaaggcaggc

SEQ ID NO: 1487 - RNA, 20 nt, Artificial Sequence
  synthesized
caucaagauugagaaguuuu

SEQ ID NO: 1488 - RNA, 20 nt, Artificial Sequence
  synthesized
caucaagauugggaaguuuu

SEQ ID NO: 1489 - RNA, 20 nt, Artificial Sequence
  synthesized
ccaaucuugauggggagaga

SEQ ID NO: 1490 - RNA, 20 nt, Artificial Sequence
  synthesized
ccaucaagauugagaaguuu

SEQ ID NO: 1491 - RNA, 20 nt, Artificial Sequence
  synthesized
cccaaucuugauggggagag

SEQ ID NO: 1492 - RNA, 20 nt, Artificial Sequence
  synthesized
cccaucaagauugagaaguu

SEQ ID NO: 1493 - RNA, 20 nt, Artificial Sequence
  synthesized
ccccaucaagauugagaagu

SEQ ID NO: 1494 - RNA, 20 nt, Artificial Sequence
  synthesized
ccugccuuugaaaacuuccc

SEQ ID NO: 1495 - RNA, 20 nt, Artificial Sequence
  synthesized
ccugccuuugaaaacuucuc

SEQ ID NO: 1496 - RNA, 20 nt, Artificial Sequence
  synthesized
ccuuugaaaacuucccaauc

SEQ ID NO: 1497 - RNA, 20 nt, Artificial Sequence
  synthesized
ccuuugaaaacuucucaauc

SEQ ID NO: 1498 - RNA, 20 nt, Artificial Sequence
  synthesized
cuccccaucaagauugagaa

SEQ ID NO: 1499 - RNA, 20 nt, Artificial Sequence
  synthesized
cuccccaucaagauugggaa

SEQ ID NO: 1500 - RNA, 20 nt, Artificial Sequence
  synthesized
cucuccccaucaagauugag

SEQ ID NO: 1501 - RNA, 20 nt, Artificial Sequence
  synthesized
cucuccccaucaagauuggg

SEQ ID NO: 1502 - RNA, 20 nt, Artificial Sequence
  synthesized
cugccuuugaaaacuuccca

SEQ ID NO: 1503 - RNA, 20 nt, Artificial Sequence
  synthesized
cugccuuugaaaacuucuca

SEQ ID NO: 1504 - RNA, 20 nt, Artificial Sequence
  synthesized
cuucccaaucuugaugggga

SEQ ID NO: 1505 - RNA, 20 nt, Artificial Sequence
  synthesized
gagaaguuuucaaaggcagg

SEQ ID NO: 1506 - RNA, 20 nt, Artificial Sequence
  synthesized
gauugagaaguuuucaaagg

SEQ ID NO: 1507 - RNA, 20 nt, Artificial Sequence
  synthesized
gauugggaaguuuucaaagg

SEQ ID NO: 1508 - RNA, 20 nt, Artificial Sequence
  synthesized
gccugccuuugaaaacuucc

SEQ ID NO: 1509 - RNA, 20 nt, Artificial Sequence
  synthesized
gccugccuuugaaaacuucu

SEQ ID NO: 1510 - RNA, 20 nt, Artificial Sequence
  synthesized
gccuuugaaaacuucccaau

SEQ ID NO: 1511 - RNA, 20 nt, Artificial Sequence
  synthesized
gccuuugaaaacuucucaau

SEQ ID NO: 1512 - RNA, 20 nt, Artificial Sequence
  synthesized
ggaaguuuucaaaggcaggc

SEQ ID NO: 1513 - RNA, 20 nt, Artificial Sequence
  synthesized
gggaaguuuucaaaggcagg

SEQ ID NO: 1514 - RNA, 20 nt, Artificial Sequence
  synthesized
ucaagauugagaaguuuuca

SEQ ID NO: 1515 - RNA, 20 nt, Artificial Sequence
  synthesized
ucaagauugggaaguuuuca

SEQ ID NO: 1516 - RNA, 20 nt, Artificial Sequence
  synthesized
uccccaucaagauugagaag

SEQ ID NO: 1517 - RNA, 20 nt, Artificial Sequence
  synthesized
uccccaucaagauugggaag

SEQ ID NO: 1518 - RNA, 20 nt, Artificial Sequence
  synthesized
ucuccccaucaagauugaga

SEQ ID NO: 1519 - RNA, 20 nt, Artificial Sequence
  synthesized
ucuccccaucaagauuggga

SEQ ID NO: 1520 - RNA, 20 nt, Artificial Sequence
  synthesized
ucucuccccaucaagauugg

SEQ ID NO: 1521 - RNA, 20 nt, Artificial Sequence
  synthesized
ugagaaguuuucaaaggcag

SEQ ID NO: 1522 - RNA, 20 nt, Artificial Sequence
  synthesized
ugccuuugaaaacuucucaa

SEQ ID NO: 1523 - RNA, 20 nt, Artificial Sequence
  synthesized
ugggaaguuuucaaaggcag

SEQ ID NO: 1524 - RNA, 20 nt, Artificial Sequence
  synthesized
uugaaaacuucucaaucuug

SEQ ID NO: 1525 - RNA, 20 nt, Artificial Sequence
  synthesized
uugagaaguuuucaaaggca

SEQ ID NO: 1526 - RNA, 20 nt, Artificial Sequence
  synthesized
uugggaaguuuucaaaggca

SEQ ID NO: 1527 - RNA, 20 nt, Artificial Sequence
  synthesized
uuugaaaacuucccaaucuu

SEQ ID NO: 1528 - RNA, 20 nt, Artificial Sequence
  synthesized
aaaaaugacagacacaggac

SEQ ID NO: 1529 - RNA, 20 nt, Artificial Sequence
  synthesized
aaaaugacagacacaggaca

SEQ ID NO: 1530 - RNA, 20 nt, Artificial Sequence
  synthesized
aaagaugacagacacaggac

SEQ ID NO: 1531 - RNA, 20 nt, Artificial Sequence
  synthesized
aaaugacagacacaggacau

SEQ ID NO: 1532 - RNA, 20 nt, Artificial Sequence
  synthesized
aagaaagaugacagacacag

SEQ ID NO: 1533 - RNA, 20 nt, Artificial Sequence
  synthesized
aagaugacagacacaggaca

SEQ ID NO: 1534 - RNA, 20 nt, Artificial Sequence
  synthesized
aaugacagacacaggacaua

SEQ ID NO: 1535 - RNA, 20 nt, Artificial Sequence
  synthesized
acuuggaaagaaaaaugaca

SEQ ID NO: 1536 - RNA, 20 nt, Artificial Sequence
  synthesized
acuuggaaagaaagaugaca

SEQ ID NO: 1537 - RNA, 20 nt, Artificial Sequence
  synthesized
agaugacagacacaggacau

SEQ ID NO: 1538 - RNA, 20 nt, Artificial Sequence
  synthesized
aucuuucuuuccaaguagaa

SEQ ID NO: 1539 - RNA, 20 nt, Artificial Sequence
  synthesized
caucuuucuuuccaaguaga

SEQ ID NO: 1540 - RNA, 20 nt, Artificial Sequence
  synthesized
cauuuuucuuuccaaguaga

SEQ ID NO: 1541 - RNA, 20 nt, Artificial Sequence
  synthesized
ccugugucugucaucuuucu

SEQ ID NO: 1542 - RNA, 20 nt, Artificial Sequence
  synthesized
ccugugucugucauuuuucu

SEQ ID NO: 1543 - RNA, 20 nt, Artificial Sequence
  synthesized
cuacuuggaaagaaagauga

SEQ ID NO: 1544 - RNA, 20 nt, Artificial Sequence
  synthesized
cugugucugucaucuuucuu

SEQ ID NO: 1545 - RNA, 20 nt, Artificial Sequence
  synthesized
cugugucugucauuuuucuu

SEQ ID NO: 1546 - RNA, 20 nt, Artificial Sequence
  synthesized
cuuggaaagaaaaaugacag

SEQ ID NO: 1547 - RNA, 20 nt, Artificial Sequence
  synthesized
cuuggaaagaaagaugacag

SEQ ID NO: 1548 - RNA, 20 nt, Artificial Sequence
  synthesized
cuuucuuuccaaguagaaca

SEQ ID NO: 1549 - RNA, 20 nt, Artificial Sequence
  synthesized
gaaaaaugacagacacagga

SEQ ID NO: 1550 - RNA, 20 nt, Artificial Sequence
  synthesized
gaaagaugacagacacagga

SEQ ID NO: 1551 - RNA, 20 nt, Artificial Sequence
  synthesized
gaugacagacacaggacaua

SEQ ID NO: 1552 - RNA, 20 nt, Artificial Sequence
  synthesized
gucugucauuuuucuuucca

SEQ ID NO: 1553 - RNA, 20 nt, Artificial Sequence
  synthesized
gugucugucaucuuucuuuc

SEQ ID NO: 1554 - RNA, 20 nt, Artificial Sequence
  synthesized
gugucugucauuuuucuuuc

SEQ ID NO: 1555 - RNA, 20 nt, Artificial Sequence
  synthesized
uauguccugugucugucauc

SEQ ID NO: 1556 - RNA, 20 nt, Artificial Sequence
  synthesized
uauguccugugucugucauu

SEQ ID NO: 1557 - RNA, 20 nt, Artificial Sequence
  synthesized
ucaucuuucuuuccaaguag

SEQ ID NO: 1558 - RNA, 20 nt, Artificial Sequence
  synthesized
ucauuuuucuuuccaaguag

SEQ ID NO: 1559 - RNA, 20 nt, Artificial Sequence
  synthesized
uccugugucugucauuuuuc

SEQ ID NO: 1560 - RNA, 20 nt, Artificial Sequence
  synthesized
ucugucaucuuucuuuccaa

SEQ ID NO: 1561 - RNA, 20 nt, Artificial Sequence
  synthesized
ucuuucuuuccaaguagaac

SEQ ID NO: 1562 - RNA, 20 nt, Artificial Sequence
  synthesized
uggaaagaaaaaugacagac

SEQ ID NO: 1563 - RNA, 20 nt, Artificial Sequence
  synthesized
uggaaagaaagaugacagac

SEQ ID NO: 1564 - RNA, 20 nt, Artificial Sequence
  synthesized
uguccugugucugucaucuu

SEQ ID NO: 1565 - RNA, 20 nt, Artificial Sequence
  synthesized
ugucugucaucuuucuuucc

SEQ ID NO: 1566 - RNA, 20 nt, Artificial Sequence
  synthesized
ugucugucauuuuucuuucc

SEQ ID NO: 1567 - RNA, 20 nt, Artificial Sequence
  synthesized
uguucuacuuggaaagaaaa

SEQ ID NO: 1568 - RNA, 20 nt, Artificial Sequence
  synthesized
uguucuacuuggaaagaaag

SEQ ID NO: 1569 - RNA, 20 nt, Artificial Sequence
  synthesized
uucuacuuggaaagaaagau

SEQ ID NO: 1570 - RNA, 20 nt, Artificial Sequence
  synthesized
uuggaaagaaaaaugacaga

SEQ ID NO: 1571 - RNA, 20 nt, Artificial Sequence
  synthesized
uuggaaagaaagaugacaga

SEQ ID NO: 1572 - RNA, 20 nt, Artificial Sequence
  synthesized
uuuucuuuccaaguagaaca

SEQ ID NO: 1573 - RNA, 20 nt, Artificial Sequence
  synthesized
uuuuucuuuccaaguagaac

SEQ ID NO: 1574 - RNA, 20 nt, Artificial Sequence
  synthesized
aaaggucuacugggguacca

SEQ ID NO: 1575 - RNA, 20 nt, Artificial Sequence
  synthesized
aaaggucugcugggguacca

SEQ ID NO: 1576 - RNA, 20 nt, Artificial Sequence
  synthesized
acagcgaaaggucuacuggg

SEQ ID NO: 1577 - RNA, 20 nt, Artificial Sequence
  synthesized
acagcgaaaggucugcuggg

SEQ ID NO: 1578 - RNA, 20 nt, Artificial Sequence
  synthesized
accccagcagaccuuucgcu

SEQ ID NO: 1579 - RNA, 20 nt, Artificial Sequence
  synthesized
accccaguagaccuuucgcu

SEQ ID NO: 1580 - RNA, 20 nt, Artificial Sequence
  synthesized
accuugaugguaccccagca

SEQ ID NO: 1581 - RNA, 20 nt, Artificial Sequence
  synthesized
accuugaugguaccccagua

SEQ ID NO: 1582 - RNA, 20 nt, Artificial Sequence
  synthesized
agcgaaaggucuacuggggu

SEQ ID NO: 1583 - RNA, 20 nt, Artificial Sequence
  synthesized
agcgaaaggucugcuggggu

SEQ ID NO: 1584 - RNA, 20 nt, Artificial Sequence
  synthesized
aggucuacugggguaccauc

SEQ ID NO: 1585 - RNA, 20 nt, Artificial Sequence
  synthesized
aggucugcugggguaccauc

SEQ ID NO: 1586 - RNA, 20 nt, Artificial Sequence
  synthesized
augguaccccagcagaccuu

SEQ ID NO: 1587 - RNA, 20 nt, Artificial Sequence
  synthesized
augguaccccaguagaccuu

SEQ ID NO: 1588 - RNA, 20 nt, Artificial Sequence
  synthesized
caaagacagcgaaaggucua

SEQ ID NO: 1589 - RNA, 20 nt, Artificial Sequence
  synthesized
caaagacagcgaaaggucug

SEQ ID NO: 1590 - RNA, 20 nt, Artificial Sequence
  synthesized
cagaccuuucgcugucuuug

SEQ ID NO: 1591 - RNA, 20 nt, Artificial Sequence
  synthesized
cagcagaccuuucgcugucu

SEQ ID NO: 1592 - RNA, 20 nt, Artificial Sequence
  synthesized
caguagaccuuucgcugucu

SEQ ID NO: 1593 - RNA, 20 nt, Artificial Sequence
  synthesized
ccagcagaccuuucgcuguc

SEQ ID NO: 1594 - RNA, 20 nt, Artificial Sequence
  synthesized
ccaguagaccuuucgcuguc

SEQ ID NO: 1595 - RNA, 20 nt, Artificial Sequence
  synthesized
cccagcagaccuuucgcugu

SEQ ID NO: 1596 - RNA, 20 nt, Artificial Sequence
  synthesized
cccaguagaccuuucgcugu

SEQ ID NO: 1597 - RNA, 20 nt, Artificial Sequence
  synthesized
ccccagcagaccuuucgcug

SEQ ID NO: 1598 - RNA, 20 nt, Artificial Sequence
  synthesized
ccccaguagaccuuucgcug

SEQ ID NO: 1599 - RNA, 20 nt, Artificial Sequence
  synthesized
ccuugaugguaccccagcag

SEQ ID NO: 1600 - RNA, 20 nt, Artificial Sequence
  synthesized
ccuugaugguaccccaguag

SEQ ID NO: 1601 - RNA, 20 nt, Artificial Sequence
  synthesized
cgaaaggucuacugggguac

SEQ ID NO: 1602 - RNA, 20 nt, Artificial Sequence
  synthesized
cgaaaggucugcugggguac

SEQ ID NO: 1603 - RNA, 20 nt, Artificial Sequence
  synthesized
cuacugggguaccaucaagg

SEQ ID NO: 1604 - RNA, 20 nt, Artificial Sequence
  synthesized
cugcugggguaccaucaagg

SEQ ID NO: 1605 - RNA, 20 nt, Artificial Sequence
  synthesized
cuugaugguaccccagcaga

SEQ ID NO: 1606 - RNA, 20 nt, Artificial Sequence
  synthesized
cuugaugguaccccaguaga

SEQ ID NO: 1607 - RNA, 20 nt, Artificial Sequence
  synthesized
gaaaggucuacugggguacc

SEQ ID NO: 1608 - RNA, 20 nt, Artificial Sequence
  synthesized
gaaaggucugcugggguacc

SEQ ID NO: 1609 - RNA, 20 nt, Artificial Sequence
  synthesized
gacagcgaaaggucuacugg

SEQ ID NO: 1610 - RNA, 20 nt, Artificial Sequence
  synthesized
gacagcgaaaggucugcugg

SEQ ID NO: 1611 - RNA, 20 nt, Artificial Sequence
  synthesized
gaugguaccccagcagaccu

SEQ ID NO: 1612 - RNA, 20 nt, Artificial Sequence
  synthesized
gaugguaccccaguagaccu

SEQ ID NO: 1613 - RNA, 20 nt, Artificial Sequence
  synthesized
gcagaccuuucgcugucuuu

SEQ ID NO: 1614 - RNA, 20 nt, Artificial Sequence
  synthesized
gcgaaaggucuacuggggua

SEQ ID NO: 1615 - RNA, 20 nt, Artificial Sequence
  synthesized
gcgaaaggucugcuggggua

SEQ ID NO: 1616 - RNA, 20 nt, Artificial Sequence
  synthesized
gguaccccagcagaccuuuc

SEQ ID NO: 1617 - RNA, 20 nt, Artificial Sequence
  synthesized
gguaccccaguagaccuuuc

SEQ ID NO: 1618 - RNA, 20 nt, Artificial Sequence
  synthesized
guaccccagcagaccuuucg

SEQ ID NO: 1619 - RNA, 20 nt, Artificial Sequence
  synthesized
guaccccaguagaccuuucg

SEQ ID NO: 1620 - RNA, 20 nt, Artificial Sequence
  synthesized
guagaccuuucgcugucuuu

SEQ ID NO: 1621 - RNA, 20 nt, Artificial Sequence
  synthesized
uaccccagcagaccuuucgc

SEQ ID NO: 1622 - RNA, 20 nt, Artificial Sequence
  synthesized
uaccccaguagaccuuucgc

SEQ ID NO: 1623 - RNA, 20 nt, Artificial Sequence
  synthesized
uacugggguaccaucaaggu

SEQ ID NO: 1624 - RNA, 20 nt, Artificial Sequence
  synthesized
uagaccuuucgcugucuuug

SEQ ID NO: 1625 - RNA, 20 nt, Artificial Sequence
  synthesized
ucuacugggguaccaucaag

SEQ ID NO: 1626 - RNA, 20 nt, Artificial Sequence
  synthesized
ucugcugggguaccaucaag

SEQ ID NO: 1627 - RNA, 20 nt, Artificial Sequence
  synthesized
ugaugguaccccagcagacc

SEQ ID NO: 1628 - RNA, 20 nt, Artificial Sequence
  synthesized
ugaugguaccccaguagacc

SEQ ID NO: 1629 - RNA, 20 nt, Artificial Sequence
  synthesized
ugcugggguaccaucaaggu

SEQ ID NO: 1630 - RNA, 20 nt, Artificial Sequence
  synthesized
ugguaccccagcagaccuuu

SEQ ID NO: 1631 - RNA, 20 nt, Artificial Sequence
  synthesized
ugguaccccaguagaccuuu

SEQ ID NO: 1632 - RNA, 20 nt, Artificial Sequence
  synthesized
uugaugguaccccagcagac

SEQ ID NO: 1633 - RNA, 20 nt, Artificial Sequence
  synthesized
uugaugguaccccaguagac

SEQ ID NO: 1634 - RNA, 20 nt, Artificial Sequence
  synthesized
aagaugagagaggauggauc

SEQ ID NO: 1635 - RNA, 20 nt, Artificial Sequence
  synthesized
aagaugagaggggauggauc

SEQ ID NO: 1636 - RNA, 20 nt, Artificial Sequence
  synthesized
accauguuuugauccauccc

SEQ ID NO: 1637 - RNA, 20 nt, Artificial Sequence
  synthesized
accauguuuugauccauccu

SEQ ID NO: 1638 - RNA, 20 nt, Artificial Sequence
  synthesized
agagaggauggaucaaaaca

SEQ ID NO: 1639 - RNA, 20 nt, Artificial Sequence
  synthesized
agaggauggaucaaaacaug

SEQ ID NO: 1640 - RNA, 20 nt, Artificial Sequence
  synthesized
agaggggauggaucaaaaca

SEQ ID NO: 1641 - RNA, 20 nt, Artificial Sequence
  synthesized
agaugagagaggauggauca

SEQ ID NO: 1642 - RNA, 20 nt, Artificial Sequence
  synthesized
agaugagaggggauggauca

SEQ ID NO: 1643 - RNA, 20 nt, Artificial Sequence
  synthesized
aggauggaucaaaacauggu

SEQ ID NO: 1644 - RNA, 20 nt, Artificial Sequence
  synthesized
aggggauggaucaaaacaug

SEQ ID NO: 1645 - RNA, 20 nt, Artificial Sequence
  synthesized
auccauccccucucaucuuc

SEQ ID NO: 1646 - RNA, 20 nt, Artificial Sequence
  synthesized
auccauccucucucaucuuc

SEQ ID NO: 1647 - RNA, 20 nt, Artificial Sequence
  synthesized
augagagaggauggaucaaa

SEQ ID NO: 1648 - RNA, 20 nt, Artificial Sequence
  synthesized
augagaggggauggaucaaa

SEQ ID NO: 1649 - RNA, 20 nt, Artificial Sequence
  synthesized
augguugaagaugagagggg

SEQ ID NO: 1650 - RNA, 20 nt, Artificial Sequence
  synthesized
auguuuugauccauccccuc

SEQ ID NO: 1651 - RNA, 20 nt, Artificial Sequence
  synthesized
auguuuugauccauccucuc

SEQ ID NO: 1652 - RNA, 20 nt, Artificial Sequence
  synthesized
cauccccucucaucuucaac

SEQ ID NO: 1653 - RNA, 20 nt, Artificial Sequence
  synthesized
cauccucucucaucuucaac

SEQ ID NO: 1654 - RNA, 20 nt, Artificial Sequence
  synthesized
cauguuuugauccauccccu

SEQ ID NO: 1655 - RNA, 20 nt, Artificial Sequence
  synthesized
cauguuuugauccauccucu

SEQ ID NO: 1656 - RNA, 20 nt, Artificial Sequence
  synthesized
ccauccccucucaucuucaa

SEQ ID NO: 1657 - RNA, 20 nt, Artificial Sequence
  synthesized
ccauguuuugauccaucccc

SEQ ID NO: 1658 - RNA, 20 nt, Artificial Sequence
  synthesized
ccauguuuugauccauccuc

SEQ ID NO: 1659 - RNA, 20 nt, Artificial Sequence
  synthesized
ccccucucaucuucaaccau

SEQ ID NO: 1660 - RNA, 20 nt, Artificial Sequence
  synthesized
cccucucaucuucaaccauc

SEQ ID NO: 1661 - RNA, 20 nt, Artificial Sequence
  synthesized
ccucucaucuucaaccaucc

SEQ ID NO: 1662 - RNA, 20 nt, Artificial Sequence
  synthesized
gaagaugagagaggauggau

SEQ ID NO: 1663 - RNA, 20 nt, Artificial Sequence
  synthesized
gaagaugagaggggauggau

SEQ ID NO: 1664 - RNA, 20 nt, Artificial Sequence
  synthesized
gagagaggauggaucaaaac

SEQ ID NO: 1665 - RNA, 20 nt, Artificial Sequence
  synthesized
gagaggauggaucaaaacau

SEQ ID NO: 1666 - RNA, 20 nt, Artificial Sequence
  synthesized
gagaggggauggaucaaaac

SEQ ID NO: 1667 - RNA, 20 nt, Artificial Sequence
  synthesized
gaggauggaucaaaacaugg

SEQ ID NO: 1668 - RNA, 20 nt, Artificial Sequence
  synthesized
gaggggauggaucaaaacau

SEQ ID NO: 1669 - RNA, 20 nt, Artificial Sequence
  synthesized
gauccauccccucucaucuu

SEQ ID NO: 1670 - RNA, 20 nt, Artificial Sequence
  synthesized
gaugagagaggauggaucaa

SEQ ID NO: 1671 - RNA, 20 nt, Artificial Sequence
  synthesized
gaugagaggggauggaucaa

SEQ ID NO: 1672 - RNA, 20 nt, Artificial Sequence
  synthesized
gaugguugaagaugagagag

SEQ ID NO: 1673 - RNA, 20 nt, Artificial Sequence
  synthesized
gaugguugaagaugagaggg

SEQ ID NO: 1674 - RNA, 20 nt, Artificial Sequence
  synthesized
gggauggaucaaaacauggu

SEQ ID NO: 1675 - RNA, 20 nt, Artificial Sequence
  synthesized
ggggauggaucaaaacaugg

SEQ ID NO: 1676 - RNA, 20 nt, Artificial Sequence
  synthesized
gguugaagaugagagaggau

SEQ ID NO: 1677 - RNA, 20 nt, Artificial Sequence
  synthesized
gguugaagaugagaggggau

SEQ ID NO: 1678 - RNA, 20 nt, Artificial Sequence
  synthesized
guugaagaugagaggggaug

SEQ ID NO: 1679 - RNA, 20 nt, Artificial Sequence
  synthesized
guuuugauccauccccucuc

SEQ ID NO: 1680 - RNA, 20 nt, Artificial Sequence
  synthesized
guuuugauccauccucucuc

SEQ ID NO: 1681 - RNA, 20 nt, Artificial Sequence
  synthesized
uccauccccucucaucuuca

SEQ ID NO: 1682 - RNA, 20 nt, Artificial Sequence
  synthesized
uccauccucucucaucuuca

SEQ ID NO: 1683 - RNA, 20 nt, Artificial Sequence
  synthesized
uccccucucaucuucaacca

SEQ ID NO: 1684 - RNA, 20 nt, Artificial Sequence
  synthesized
ugaagaugagagaggaugga

SEQ ID NO: 1685 - RNA, 20 nt, Artificial Sequence
  synthesized
ugaagaugagaggggaugga

SEQ ID NO: 1686 - RNA, 20 nt, Artificial Sequence
  synthesized
ugagagaggauggaucaaaa

SEQ ID NO: 1687 - RNA, 20 nt, Artificial Sequence
  synthesized
ugagaggggauggaucaaaa

SEQ ID NO: 1688 - RNA, 20 nt, Artificial Sequence
  synthesized
ugauccauccccucucaucu

SEQ ID NO: 1689 - RNA, 20 nt, Artificial Sequence
  synthesized
ugauccauccucucucaucu

SEQ ID NO: 1690 - RNA, 20 nt, Artificial Sequence
  synthesized
ugguugaagaugagagagga

SEQ ID NO: 1691 - RNA, 20 nt, Artificial Sequence
  synthesized
ugguugaagaugagagggga

SEQ ID NO: 1692 - RNA, 20 nt, Artificial Sequence
  synthesized
uguuuugauccauccccucu

SEQ ID NO: 1693 - RNA, 20 nt, Artificial Sequence
  synthesized
uguuuugauccauccucucu

SEQ ID NO: 1694 - RNA, 20 nt, Artificial Sequence
  synthesized
uugaagaugagagaggaugg

SEQ ID NO: 1695 - RNA, 20 nt, Artificial Sequence
  synthesized
uugaagaugagaggggaugg

SEQ ID NO: 1696 - RNA, 20 nt, Artificial Sequence
  synthesized
uugauccauccccucucauc

SEQ ID NO: 1697 - RNA, 20 nt, Artificial Sequence
  synthesized
uugauccauccucucucauc

SEQ ID NO: 1698 - RNA, 20 nt, Artificial Sequence
  synthesized
uuugauccauccccucucau

SEQ ID NO: 1699 - RNA, 20 nt, Artificial Sequence
  synthesized
uuugauccauccucucucau

SEQ ID NO: 1700 - RNA, 20 nt, Artificial Sequence
  synthesized
uuuugauccauccccucuca

SEQ ID NO: 1701 - RNA, 20 nt, Artificial Sequence
  synthesized
uuuugauccauccucucuca

SEQ ID NO: 1702 - RNA, 20 nt, Artificial Sequence
  synthesized
aagaguguuaacgggaaauc

SEQ ID NO: 1703 - RNA, 20 nt, Artificial Sequence
  synthesized
aaugauuucccguuaacacu

SEQ ID NO: 1704 - RNA, 20 nt, Artificial Sequence
  synthesized
augauuucccauuaacacuc

SEQ ID NO: 1705 - RNA, 20 nt, Artificial Sequence
  synthesized
augauuucccguuaacacuc

SEQ ID NO: 1706 - RNA, 20 nt, Artificial Sequence
  synthesized
auuucccguuaacacucuug

SEQ ID NO: 1707 - RNA, 20 nt, Artificial Sequence
  synthesized
caagaguguuaacgggaaau

SEQ ID NO: 1708 - RNA, 20 nt, Artificial Sequence
  synthesized
ccuaaugauuucccguuaac

SEQ ID NO: 1709 - RNA, 20 nt, Artificial Sequence
  synthesized
cuaaugauuucccguuaaca

SEQ ID NO: 1710 - RNA, 20 nt, Artificial Sequence
  synthesized
gaguguuaacgggaaaucau

SEQ ID NO: 1711 - RNA, 20 nt, Artificial Sequence
  synthesized
gauuucccauuaacacucuu

SEQ ID NO: 1712 - RNA, 20 nt, Artificial Sequence
  synthesized
gauuucccguuaacacucuu

SEQ ID NO: 1713 - RNA, 20 nt, Artificial Sequence
  synthesized
uaaugauuucccguuaacac

SEQ ID NO: 1714 - RNA, 20 nt, Artificial Sequence
  synthesized
ucaagaguguuaacgggaaa

SEQ ID NO: 1715 - RNA, 20 nt, Artificial Sequence
  synthesized
ucaagaguguuaaugggaaa

SEQ ID NO: 1716 - RNA, 20 nt, Artificial Sequence
  synthesized
uucaagaguguuaacgggaa

SEQ ID NO: 1717 - RNA, 20 nt, Artificial Sequence
  synthesized
uucaagaguguuaaugggaa

SEQ ID NO: 1718 - RNA, 20 nt, Artificial Sequence
  synthesized
uuucaagaguguuaacggga

SEQ ID NO: 1719 - RNA, 20 nt, Artificial Sequence
  synthesized
uuucaagaguguuaauggga

SEQ ID NO: 1720 - RNA, 20 nt, Artificial Sequence
  synthesized
uuuucaagaguguuaacggg

SEQ ID NO: 1721 - RNA, 20 nt, Artificial Sequence
  synthesized
aaauauucacuaggcaccua

SEQ ID NO: 1722 - RNA, 20 nt, Artificial Sequence
  synthesized
aaguaggugccuagugaaua

SEQ ID NO: 1723 - RNA, 20 nt, Artificial Sequence
  synthesized
aauauucacuaggcaccuac

SEQ ID NO: 1724 - RNA, 20 nt, Artificial Sequence
  synthesized
acaaguaggugccuagugaa

SEQ ID NO: 1725 - RNA, 20 nt, Artificial Sequence
  synthesized
agacaaguaggugccuaaug

SEQ ID NO: 1726 - RNA, 20 nt, Artificial Sequence
  synthesized
agacaaguaggugccuagug

SEQ ID NO: 1727 - RNA, 20 nt, Artificial Sequence
  synthesized
auauucacuaggcaccuacu

SEQ ID NO: 1728 - RNA, 20 nt, Artificial Sequence
  synthesized
auauucauuaggcaccuacu

SEQ ID NO: 1729 - RNA, 20 nt, Artificial Sequence
  synthesized
auucacuaggcaccuacuug

SEQ ID NO: 1730 - RNA, 20 nt, Artificial Sequence
  synthesized
auucauuaggcaccuacuug

SEQ ID NO: 1731 - RNA, 20 nt, Artificial Sequence
  synthesized
caaauauucacuaggcaccu

SEQ ID NO: 1732 - RNA, 20 nt, Artificial Sequence
  synthesized
caaguaggugccuagugaau

SEQ ID NO: 1733 - RNA, 20 nt, Artificial Sequence
  synthesized
cacuaggcaccuacuugucu

SEQ ID NO: 1734 - RNA, 20 nt, Artificial Sequence
  synthesized
cauuaggcaccuacuugucu

SEQ ID NO: 1735 - RNA, 20 nt, Artificial Sequence
  synthesized
cuaggcaccuacuugucuca

SEQ ID NO: 1736 - RNA, 20 nt, Artificial Sequence
  synthesized
gacaaguaggugccuaauga

SEQ ID NO: 1737 - RNA, 20 nt, Artificial Sequence
  synthesized
gacaaguaggugccuaguga

SEQ ID NO: 1738 - RNA, 20 nt, Artificial Sequence
  synthesized
gagacaaguaggugccuaau

SEQ ID NO: 1739 - RNA, 20 nt, Artificial Sequence
  synthesized
gagacaaguaggugccuagu

SEQ ID NO: 1740 - RNA, 20 nt, Artificial Sequence
  synthesized
uauucacuaggcaccuacuu

SEQ ID NO: 1741 - RNA, 20 nt, Artificial Sequence
  synthesized
uauucauuaggcaccuacuu

SEQ ID NO: 1742 - RNA, 20 nt, Artificial Sequence
  synthesized
uuaggcaccuacuugucuca

SEQ ID NO: 1743 - RNA, 20 nt, Artificial Sequence
  synthesized
uucacuaggcaccuacuugu

SEQ ID NO: 1744 - RNA, 20 nt, Artificial Sequence
  synthesized
uucauuaggcaccuacuugu

SEQ ID NO: 1745 - RNA, 20 nt, Artificial Sequence
  synthesized
aagucagaggggcugucacu

SEQ ID NO: 1746 - RNA, 20 nt, Artificial Sequence
  synthesized
acucucggcugagggacuga

SEQ ID NO: 1747 - RNA, 20 nt, Artificial Sequence
  synthesized
agaagucagaggggcuguca

SEQ ID NO: 1748 - RNA, 20 nt, Artificial Sequence
  synthesized
agaagucagaggggcugucc

SEQ ID NO: 1749 - RNA, 20 nt, Artificial Sequence
  synthesized
agagggacagccccucugac

SEQ ID NO: 1750 - RNA, 20 nt, Artificial Sequence
  synthesized
agaggggcugucacucucgg

SEQ ID NO: 1751 - RNA, 20 nt, Artificial Sequence
  synthesized
agaggggcugucccucucgg

SEQ ID NO: 1752 - RNA, 20 nt, Artificial Sequence
  synthesized
agagugacagccccucugac

SEQ ID NO: 1753 - RNA, 20 nt, Artificial Sequence
  synthesized
agccgagagggacagccccu

SEQ ID NO: 1754 - RNA, 20 nt, Artificial Sequence
  synthesized
agccgagagugacagccccu

SEQ ID NO: 1755 - RNA, 20 nt, Artificial Sequence
  synthesized
agggacagccccucugacuu

SEQ ID NO: 1756 - RNA, 20 nt, Artificial Sequence
  synthesized
aggggcugucacucucggcu

SEQ ID NO: 1757 - RNA, 20 nt, Artificial Sequence
  synthesized
aggggcugucccucucggcu

SEQ ID NO: 1758 - RNA, 20 nt, Artificial Sequence
  synthesized
agucagaggggcugucacuc

SEQ ID NO: 1759 - RNA, 20 nt, Artificial Sequence
  synthesized
agucagaggggcugucccuc

SEQ ID NO: 1760 - RNA, 20 nt, Artificial Sequence
  synthesized
agucccucagccgagaggga

SEQ ID NO: 1761 - RNA, 20 nt, Artificial Sequence
  synthesized
agucccucagccgagaguga

SEQ ID NO: 1762 - RNA, 20 nt, Artificial Sequence
  synthesized
agugacagccccucugacuu

SEQ ID NO: 1763 - RNA, 20 nt, Artificial Sequence
  synthesized
cagaggggcugucacucucg

SEQ ID NO: 1764 - RNA, 20 nt, Artificial Sequence
  synthesized
cagaggggcugucccucucg

SEQ ID NO: 1765 - RNA, 20 nt, Artificial Sequence
  synthesized
cagccgagagggacagcccc

SEQ ID NO: 1766 - RNA, 20 nt, Artificial Sequence
  synthesized
cagccgagagugacagcccc

SEQ ID NO: 1767 - RNA, 20 nt, Artificial Sequence
  synthesized
cagucccucagccgagaggg

SEQ ID NO: 1768 - RNA, 20 nt, Artificial Sequence
  synthesized
cagucccucagccgagagug

SEQ ID NO: 1769 - RNA, 20 nt, Artificial Sequence
  synthesized
cccucagccgagagggacag

SEQ ID NO: 1770 - RNA, 20 nt, Artificial Sequence
  synthesized
cccucagccgagagugacag

SEQ ID NO: 1771 - RNA, 20 nt, Artificial Sequence
  synthesized
ccgagagggacagccccucu

SEQ ID NO: 1772 - RNA, 20 nt, Artificial Sequence
  synthesized
ccgagagugacagccccucu

SEQ ID NO: 1773 - RNA, 20 nt, Artificial Sequence
  synthesized
ccucagccgagagggacagc

SEQ ID NO: 1774 - RNA, 20 nt, Artificial Sequence
  synthesized
ccucagccgagagugacagc

SEQ ID NO: 1775 - RNA, 20 nt, Artificial Sequence
  synthesized
ccucucggcugagggacuga

SEQ ID NO: 1776 - RNA, 20 nt, Artificial Sequence
  synthesized
cgagagugacagccccucug

SEQ ID NO: 1777 - RNA, 20 nt, Artificial Sequence
  synthesized
cucagccgagagggacagcc

SEQ ID NO: 1778 - RNA, 20 nt, Artificial Sequence
  synthesized
cucagccgagagugacagcc

SEQ ID NO: 1779 - RNA, 20 nt, Artificial Sequence
  synthesized
cugucacucucggcugaggg

SEQ ID NO: 1780 - RNA, 20 nt, Artificial Sequence
  synthesized
cugucccucucggcugaggg

SEQ ID NO: 1781 - RNA, 20 nt, Artificial Sequence
  synthesized
gaagucagaggggcugucac

SEQ ID NO: 1782 - RNA, 20 nt, Artificial Sequence
  synthesized
gagagugacagccccucuga

SEQ ID NO: 1783 - RNA, 20 nt, Artificial Sequence
  synthesized
gagggacagccccucugacu

SEQ ID NO: 1784 - RNA, 20 nt, Artificial Sequence
  synthesized
gagugacagccccucugacu

SEQ ID NO: 1785 - RNA, 20 nt, Artificial Sequence
  synthesized
gcugucacucucggcugagg

SEQ ID NO: 1786 - RNA, 20 nt, Artificial Sequence
  synthesized
gcugucccucucggcugagg

SEQ ID NO: 1787 - RNA, 20 nt, Artificial Sequence
  synthesized
ggacagccccucugacuucu

SEQ ID NO: 1788 - RNA, 20 nt, Artificial Sequence
  synthesized
gggacagccccucugacuuc

SEQ ID NO: 1789 - RNA, 20 nt, Artificial Sequence
  synthesized
gucccucagccgagagggac

SEQ ID NO: 1790 - RNA, 20 nt, Artificial Sequence
  synthesized
gucccucagccgagagugac

SEQ ID NO: 1791 - RNA, 20 nt, Artificial Sequence
  synthesized
gugacagccccucugacuuc

SEQ ID NO: 1792 - RNA, 20 nt, Artificial Sequence
  synthesized
ucacucucggcugagggacu

SEQ ID NO: 1793 - RNA, 20 nt, Artificial Sequence
  synthesized
ucagaggggcugucacucuc

SEQ ID NO: 1794 - RNA, 20 nt, Artificial Sequence
  synthesized
ucagaggggcugucccucuc

SEQ ID NO: 1795 - RNA, 20 nt, Artificial Sequence
  synthesized
ucagccgagagggacagccc

SEQ ID NO: 1796 - RNA, 20 nt, Artificial Sequence
  synthesized
ucagccgagagugacagccc

SEQ ID NO: 1797 - RNA, 20 nt, Artificial Sequence
  synthesized
ucccucagccgagagggaca

SEQ ID NO: 1798 - RNA, 20 nt, Artificial Sequence
  synthesized
ucccucagccgagagugaca

SEQ ID NO: 1799 - RNA, 20 nt, Artificial Sequence
  synthesized
ucccucucggcugagggacu

SEQ ID NO: 1800 - RNA, 20 nt, Artificial Sequence
  synthesized
ugacagccccucugacuucu

SEQ ID NO: 1801 - RNA, 20 nt, Artificial Sequence
  synthesized
ugucacucucggcugaggga

SEQ ID NO: 1802 - RNA, 20 nt, Artificial Sequence
  synthesized
ugucccucucggcugaggga

SEQ ID NO: 1803 - RNA, 20 nt, Artificial Sequence
  synthesized
aagcagcugcucuguggggc

SEQ ID NO: 1804 - RNA, 20 nt, Artificial Sequence
  synthesized
acagagcagcugcuucuggg

SEQ ID NO: 1805 - RNA, 20 nt, Artificial Sequence
  synthesized
acagaggagcugcuucuggg

SEQ ID NO: 1806 - RNA, 20 nt, Artificial Sequence
  synthesized
acagcugccccacagagcag

SEQ ID NO: 1807 - RNA, 20 nt, Artificial Sequence
  synthesized
acagcugccccacagaggag

SEQ ID NO: 1808 - RNA, 20 nt, Artificial Sequence
  synthesized
agaagcagcugcucuguggg

SEQ ID NO: 1809 - RNA, 20 nt, Artificial Sequence
  synthesized
agagcagcugcuucugggaa

SEQ ID NO: 1810 - RNA, 20 nt, Artificial Sequence
  synthesized
agaggagcugcuucugggaa

SEQ ID NO: 1811 - RNA, 20 nt, Artificial Sequence
  synthesized
agcagcugcucuguggggca

SEQ ID NO: 1812 - RNA, 20 nt, Artificial Sequence
  synthesized
agcugccccacagagcagcu

SEQ ID NO: 1813 - RNA, 20 nt, Artificial Sequence
  synthesized
aggauucccagaagcagcuc

SEQ ID NO: 1814 - RNA, 20 nt, Artificial Sequence
  synthesized
aggauucccagaagcagcug

SEQ ID NO: 1815 - RNA, 20 nt, Artificial Sequence
  synthesized
cacagagcagcugcuucugg

SEQ ID NO: 1816 - RNA, 20 nt, Artificial Sequence
  synthesized
cacagaggagcugcuucugg

SEQ ID NO: 1817 - RNA, 20 nt, Artificial Sequence
  synthesized
cagaagcagcuccucugugg

SEQ ID NO: 1818 - RNA, 20 nt, Artificial Sequence
  synthesized
cagaagcagcugcucugugg

SEQ ID NO: 1819 - RNA, 20 nt, Artificial Sequence
  synthesized
cagagcagcugcuucuggga

SEQ ID NO: 1820 - RNA, 20 nt, Artificial Sequence
  synthesized
cagaggagcugcuucuggga

SEQ ID NO: 1821 - RNA, 20 nt, Artificial Sequence
  synthesized
cagcugccccacagagcagc

SEQ ID NO: 1822 - RNA, 20 nt, Artificial Sequence
  synthesized
accgggcggcgcucacugcc

SEQ ID NO: 1823 - RNA, 20 nt, Artificial Sequence
  synthesized
accgggcugcgcucacugcc

SEQ ID NO: 1824 - RNA, 20 nt, Artificial Sequence
  synthesized
acucgaccgggcggcgcuca

SEQ ID NO: 1825 - RNA, 20 nt, Artificial Sequence
  synthesized
acucgaccgggcugcgcuca

SEQ ID NO: 1826 - RNA, 20 nt, Artificial Sequence
  synthesized
agugagcgcagcccggucga

SEQ ID NO: 1827 - RNA, 20 nt, Artificial Sequence
  synthesized
agugagcgccgcccggucga

SEQ ID NO: 1828 - RNA, 20 nt, Artificial Sequence
  synthesized
cagcccggucgagucccgag

SEQ ID NO: 1829 - RNA, 20 nt, Artificial Sequence
  synthesized
cagugagcgcagcccggucg

SEQ ID NO: 1830 - RNA, 20 nt, Artificial Sequence
  synthesized
cagugagcgccgcccggucg

SEQ ID NO: 1831 - RNA, 20 nt, Artificial Sequence
  synthesized
ccgcccggucgagucccgag

SEQ ID NO: 1832 - RNA, 20 nt, Artificial Sequence
  synthesized
ccggcugggcagugagcgca

SEQ ID NO: 1833 - RNA, 20 nt, Artificial Sequence
  synthesized
ccggcugggcagugagcgcc

SEQ ID NO: 1834 - RNA, 20 nt, Artificial Sequence
  synthesized
ccgggcugcgcucacugccc

SEQ ID NO: 1835 - RNA, 20 nt, Artificial Sequence
  synthesized
ccucgggacucgaccgggcg

SEQ ID NO: 1836 - RNA, 20 nt, Artificial Sequence
  synthesized
ccucgggacucgaccgggcu

SEQ ID NO: 1837 - RNA, 20 nt, Artificial Sequence
  synthesized
cgggacucgaccgggcugcg

SEQ ID NO: 1838 - RNA, 20 nt, Artificial Sequence
  synthesized
cgggcggcgcucacugccca

SEQ ID NO: 1839 - RNA, 20 nt, Artificial Sequence
  synthesized
cgggcugcgcucacugccca

SEQ ID NO: 1840 - RNA, 20 nt, Artificial Sequence
  synthesized
cucgaccgggcggcgcucac

SEQ ID NO: 1841 - RNA, 20 nt, Artificial Sequence
  synthesized
cucgaccgggcugcgcucac

SEQ ID NO: 1842 - RNA, 20 nt, Artificial Sequence
  synthesized
cucgggacucgaccgggcgg

SEQ ID NO: 1843 - RNA, 20 nt, Artificial Sequence
  synthesized
cucgggacucgaccgggcug

SEQ ID NO: 1844 - RNA, 20 nt, Artificial Sequence
  synthesized
cugggcagugagcgcagccc

SEQ ID NO: 1845 - RNA, 20 nt, Artificial Sequence
  synthesized
cugggcagugagcgccgccc

SEQ ID NO: 1846 - RNA, 20 nt, Artificial Sequence
  synthesized
gaccgggcggcgcucacugc

SEQ ID NO: 1847 - RNA, 20 nt, Artificial Sequence
  synthesized
gaccgggcugcgcucacugc

SEQ ID NO: 1848 - RNA, 20 nt, Artificial Sequence
  synthesized
gacucgaccgggcggcgcuc

SEQ ID NO: 1849 - RNA, 20 nt, Artificial Sequence
  synthesized
gacucgaccgggcugcgcuc

SEQ ID NO: 1850 - RNA, 20 nt, Artificial Sequence
  synthesized
gagcgcagcccggucgaguc

SEQ ID NO: 1851 - RNA, 20 nt, Artificial Sequence
  synthesized
gagcgccgcccggucgaguc

SEQ ID NO: 1852 - RNA, 20 nt, Artificial Sequence
  synthesized
gcagugagcgcagcccgguc

SEQ ID NO: 1853 - RNA, 20 nt, Artificial Sequence
  synthesized
gcagugagcgccgcccgguc

SEQ ID NO: 1854 - RNA, 20 nt, Artificial Sequence
  synthesized
gcgcagcccggucgaguccc

SEQ ID NO: 1855 - RNA, 20 nt, Artificial Sequence
  synthesized
ggacucgaccgggcggcgcu

SEQ ID NO: 1856 - RNA, 20 nt, Artificial Sequence
  synthesized
ggacucgaccgggcugcgcu

SEQ ID NO: 1857 - RNA, 20 nt, Artificial Sequence
  synthesized
ggcgcucacugcccagccgg

SEQ ID NO: 1858 - RNA, 20 nt, Artificial Sequence
  synthesized
ggcugggcagugagcgcagc

SEQ ID NO: 1859 - RNA, 20 nt, Artificial Sequence
  synthesized
ggcugggcagugagcgccgc

SEQ ID NO: 1860 - RNA, 20 nt, Artificial Sequence
  synthesized
gggacucgaccgggcugcgc

SEQ ID NO: 1861 - RNA, 20 nt, Artificial Sequence
  synthesized
gggcggcgcucacugcccag

SEQ ID NO: 1862 - RNA, 20 nt, Artificial Sequence
  synthesized
gggcugcgcucacugcccag

SEQ ID NO: 1863 - RNA, 20 nt, Artificial Sequence
  synthesized
gugagcgcagcccggucgag

SEQ ID NO: 1864 - RNA, 20 nt, Artificial Sequence
  synthesized
gugagcgccgcccggucgag

SEQ ID NO: 1865 - RNA, 20 nt, Artificial Sequence
  synthesized
ucgaccgggcggcgcucacu

SEQ ID NO: 1866 - RNA, 20 nt, Artificial Sequence
  synthesized
ucgaccgggcugcgcucacu

SEQ ID NO: 1867 - RNA, 20 nt, Artificial Sequence
  synthesized
ucgggacucgaccgggcggc

SEQ ID NO: 1868 - RNA, 20 nt, Artificial Sequence
  synthesized
ucgggacucgaccgggcugc

SEQ ID NO: 1869 - RNA, 20 nt, Artificial Sequence
  synthesized
ugagcgcagcccggucgagu

SEQ ID NO: 1870 - RNA, 20 nt, Artificial Sequence
  synthesized
ugagcgccgcccggucgagu

SEQ ID NO: 1871 - RNA, 20 nt, Artificial Sequence
  synthesized
ugcgcucacugcccagccgg

SEQ ID NO: 1872 - RNA, 20 nt, Artificial Sequence
  synthesized
ugggcagugagcgcagcccg

SEQ ID NO: 1873 - RNA, 20 nt, Artificial Sequence
  synthesized
ugggcagugagcgccgcccg

SEQ ID NO: 1874 - RNA, 20 nt, Artificial Sequence
  synthesized
ccacagcugccccacagagg

SEQ ID NO: 1875 - RNA, 20 nt, Artificial Sequence
  synthesized
cugccccacagagcagcugc

SEQ ID NO: 1876 - RNA, 20 nt, Artificial Sequence
  synthesized
gaagcagcuccucugugggg

SEQ ID NO: 1877 - RNA, 20 nt, Artificial Sequence
  synthesized
gagcagcugcuucugggaau

SEQ ID NO: 1878 - RNA, 20 nt, Artificial Sequence
  synthesized
gaggagcugcuucugggaau

SEQ ID NO: 1879 - RNA, 20 nt, Artificial Sequence
  synthesized
gauucccagaagcagcuccu

SEQ ID NO: 1880 - RNA, 20 nt, Artificial Sequence
  synthesized
gauucccagaagcagcugcu

SEQ ID NO: 1881 - RNA, 20 nt, Artificial Sequence
  synthesized
gcagcuccucuguggggcag

SEQ ID NO: 1882 - RNA, 20 nt, Artificial Sequence
  synthesized
gcagcugcucuguggggcag

SEQ ID NO: 1883 - RNA, 20 nt, Artificial Sequence
  synthesized
gccccacagagcagcugcuu

SEQ ID NO: 1884 - RNA, 20 nt, Artificial Sequence
  synthesized
gcugccccacagaggagcug

SEQ ID NO: 1885 - RNA, 20 nt, Artificial Sequence
  synthesized
ggagcugcuucugggaaucc

SEQ ID NO: 1886 - RNA, 20 nt, Artificial Sequence
  synthesized
ggauucccagaagcagcucc

SEQ ID NO: 1887 - RNA, 20 nt, Artificial Sequence
  synthesized
ggauucccagaagcagcugc

SEQ ID NO: 1888 - RNA, 20 nt, Artificial Sequence
  synthesized
uccucuguggggcagcugug

SEQ ID NO: 1889 - RNA, 20 nt, Artificial Sequence
  synthesized
ugccccacagagcagcugcu

SEQ ID NO: 1890 - RNA, 20 nt, Artificial Sequence
  synthesized
ugccccacagaggagcugcu

SEQ ID NO: 1891 - RNA, 20 nt, Artificial Sequence
  synthesized
ugcucuguggggcagcugug

SEQ ID NO: 1892 - RNA, 20 nt, Artificial Sequence
  synthesized
uucccagaagcagcuccucu

SEQ ID NO: 1893 - RNA, 20 nt, Artificial Sequence
  synthesized
uucccagaagcagcugcucu

SEQ ID NO: 1894 - RNA, 20 nt, Artificial Sequence
  synthesized
aagagguguaagugugucca

SEQ ID NO: 1895 - RNA, 20 nt, Artificial Sequence
  synthesized
aaguguguccaguuggacug

SEQ ID NO: 1896 - RNA, 20 nt, Artificial Sequence
  synthesized
acacacuuacaccucuuagu

SEQ ID NO: 1897 - RNA, 20 nt, Artificial Sequence
  synthesized
acacuuacaccucuuaguag

SEQ ID NO: 1898 - RNA, 20 nt, Artificial Sequence
  synthesized
acccacuuacaccucuuagu

SEQ ID NO: 1899 - RNA, 20 nt, Artificial Sequence
  synthesized
acuaagagguguaagugugu

SEQ ID NO: 1900 - RNA, 20 nt, Artificial Sequence
  synthesized
acuggacacacuuacaccuc

SEQ ID NO: 1901 - RNA, 20 nt, Artificial Sequence
  synthesized
agagguguaaguguguccag

SEQ ID NO: 1902 - RNA, 20 nt, Artificial Sequence
  synthesized
aguccaacuggacacacuua

SEQ ID NO: 1903 - RNA, 20 nt, Artificial Sequence
  synthesized
aguguguccaguuggacugg

SEQ ID NO: 1904 - RNA, 20 nt, Artificial Sequence
  synthesized
caacuggacacacuuacacc

SEQ ID NO: 1905 - RNA, 20 nt, Artificial Sequence
  synthesized
cacacuuacaccucuuagua

SEQ ID NO: 1906 - RNA, 20 nt, Artificial Sequence
  synthesized
caguccaacuggacacacuu

SEQ ID NO: 1907 - RNA, 20 nt, Artificial Sequence
  synthesized
ccaacuggacacacuuacac

SEQ ID NO: 1908 - RNA, 20 nt, Artificial Sequence
  synthesized
ccaguccaacuggacacacu

SEQ ID NO: 1909 - RNA, 20 nt, Artificial Sequence
  synthesized
cccacuuacaccucuuagua

SEQ ID NO: 1910 - RNA, 20 nt, Artificial Sequence
  synthesized
cuaagagguguaaguguguc

SEQ ID NO: 1911 - RNA, 20 nt, Artificial Sequence
  synthesized
cuacuaagagguguaagugu

SEQ ID NO: 1912 - RNA, 20 nt, Artificial Sequence
  synthesized
cuggacacacuuacaccucu

SEQ ID NO: 1913 - RNA, 20 nt, Artificial Sequence
  synthesized
gacacacuuacaccucuuag

SEQ ID NO: 1914 - RNA, 20 nt, Artificial Sequence
  synthesized
gaccaguccaacuggacaca

SEQ ID NO: 1915 - RNA, 20 nt, Artificial Sequence
  synthesized
ggacacacuuacaccucuua

SEQ ID NO: 1916 - RNA, 20 nt, Artificial Sequence
  synthesized
gguguaaguguguccaguug

SEQ ID NO: 1917 - RNA, 20 nt, Artificial Sequence
  synthesized
guccaacuggacacacuuac

SEQ ID NO: 1918 - RNA, 20 nt, Artificial Sequence
  synthesized
guguguccaguuggacuggu

SEQ ID NO: 1919 - RNA, 20 nt, Artificial Sequence
  synthesized
uaagagguguaagugugucc

SEQ ID NO: 1920 - RNA, 20 nt, Artificial Sequence
  synthesized
uaaguguguccaguuggacu

SEQ ID NO: 1921 - RNA, 20 nt, Artificial Sequence
  synthesized
uacuaagagguguaagugug

SEQ ID NO: 1922 - RNA, 20 nt, Artificial Sequence
  synthesized
uccaacuggacacacuuaca

SEQ ID NO: 1923 - RNA, 20 nt, Artificial Sequence
  synthesized
ugaccaguccaacuggacac

SEQ ID NO: 1924 - RNA, 20 nt, Artificial Sequence
  synthesized
uguaaguguguccaguugga

SEQ ID NO: 1925 - RNA, 20 nt, Artificial Sequence
  synthesized
uguccaguuggacuggucaa

SEQ ID NO: 1926 - RNA, 20 nt, Artificial Sequence
  synthesized
uugaccaguccaacuggaca

SEQ ID NO: 1927 - RNA, 20 nt, Artificial Sequence
  synthesized
acugaagcgagaucgggcca

SEQ ID NO: 1928 - RNA, 20 nt, Artificial Sequence
  synthesized
aguggcccgaucucgcuuca

SEQ ID NO: 1929 - RNA, 20 nt, Artificial Sequence
  synthesized
cacugaagcgagaucgggcc

SEQ ID NO: 1930 - RNA, 20 nt, Artificial Sequence
  synthesized
cccgaucucgcuucagugca

SEQ ID NO: 1931 - RNA, 20 nt, Artificial Sequence
  synthesized
ccgaucucgcuucagugcaa

SEQ ID NO: 1932 - RNA, 20 nt, Artificial Sequence
  synthesized
ccugaucucgcuucagugca

SEQ ID NO: 1933 - RNA, 20 nt, Artificial Sequence
  synthesized
cgaucucgcuucagugcaaa

SEQ ID NO: 1934 - RNA, 20 nt, Artificial Sequence
  synthesized
cugaagcgagaucgggccac

SEQ ID NO: 1935 - RNA, 20 nt, Artificial Sequence
  synthesized
cugaucucgcuucagugcaa

SEQ ID NO: 1936 - RNA, 20 nt, Artificial Sequence
  synthesized
gcacugaagcgagaucgggc

SEQ ID NO: 1937 - RNA, 20 nt, Artificial Sequence
  synthesized
gcaguggcccgaucucgcuu

SEQ ID NO: 1938 - RNA, 20 nt, Artificial Sequence
  synthesized
gcccgaucucgcuucagugc

SEQ ID NO: 1939 - RNA, 20 nt, Artificial Sequence
  synthesized
gccugaucucgcuucagugc

SEQ ID NO: 1940 - RNA, 20 nt, Artificial Sequence
  synthesized
ggcccgaucucgcuucagug

SEQ ID NO: 1941 - RNA, 20 nt, Artificial Sequence
  synthesized
ggccugaucucgcuucagug

SEQ ID NO: 1942 - RNA, 20 nt, Artificial Sequence
  synthesized
guggcccgaucucgcuucag

SEQ ID NO: 1943 - RNA, 20 nt, Artificial Sequence
  synthesized
ugaucucgcuucagugcaaa

SEQ ID NO: 1944 - RNA, 20 nt, Artificial Sequence
  synthesized
ugcacugaagcgagaucggg

SEQ ID NO: 1945 - RNA, 20 nt, Artificial Sequence
  synthesized
ugcaguggcccgaucucgcu

SEQ ID NO: 1946 - RNA, 20 nt, Artificial Sequence
  synthesized
uugcacugaagcgagaucgg

SEQ ID NO: 1947 - RNA, 20 nt, Artificial Sequence
  synthesized
uuugcacugaagcgagauca

SEQ ID NO: 1948 - RNA, 20 nt, Artificial Sequence
  synthesized
uuugcacugaagcgagaucg

SEQ ID NO: 1949 - RNA, 20 nt, Artificial Sequence
  synthesized
aaaagaccccuaccagcugg

SEQ ID NO: 1950 - RNA, 20 nt, Artificial Sequence
  synthesized
aaaagacuccuaccagcugg

SEQ ID NO: 1951 - RNA, 20 nt, Artificial Sequence
  synthesized
aagaccccuaccagcugggc

SEQ ID NO: 1952 - RNA, 20 nt, Artificial Sequence
  synthesized
aagacuccuaccagcugggc

SEQ ID NO: 1953 - RNA, 20 nt, Artificial Sequence
  synthesized
accacgcccagcugguagga

SEQ ID NO: 1954 - RNA, 20 nt, Artificial Sequence
  synthesized
accacgcccagcugguaggg

SEQ ID NO: 1955 - RNA, 20 nt, Artificial Sequence
  synthesized
acgcccagcugguaggaguc

SEQ ID NO: 1956 - RNA, 20 nt, Artificial Sequence
  synthesized
acgcccagcugguagggguc

SEQ ID NO: 1957 - RNA, 20 nt, Artificial Sequence
  synthesized
agcugguaggagucuuuuca

SEQ ID NO: 1958 - RNA, 20 nt, Artificial Sequence
  synthesized
agcugguaggggucuuuuca

SEQ ID NO: 1959 - RNA, 20 nt, Artificial Sequence
  synthesized
aggagucuuuucaaucccuc

SEQ ID NO: 1960 - RNA, 20 nt, Artificial Sequence
  synthesized
agggagggauugaaaagacc

SEQ ID NO: 1961 - RNA, 20 nt, Artificial Sequence
  synthesized
agggagggauugaaaagacu

SEQ ID NO: 1962 - RNA, 20 nt, Artificial Sequence
  synthesized
agggauugaaaagaccccua

SEQ ID NO: 1963 - RNA, 20 nt, Artificial Sequence
  synthesized
agggauugaaaagacuccua

SEQ ID NO: 1964 - RNA, 20 nt, Artificial Sequence
  synthesized
aggggucuuuucaaucccuc

SEQ ID NO: 1965 - RNA, 20 nt, Artificial Sequence
  synthesized
auugaaaagaccccuaccag

SEQ ID NO: 1966 - RNA, 20 nt, Artificial Sequence
  synthesized
auugaaaagacuccuaccag

SEQ ID NO: 1967 - RNA, 20 nt, Artificial Sequence
  synthesized
cacgcccagcugguaggagu

SEQ ID NO: 1968 - RNA, 20 nt, Artificial Sequence
  synthesized
cacgcccagcugguaggggu

SEQ ID NO: 1969 - RNA, 20 nt, Artificial Sequence
  synthesized
cagcugguaggagucuuuuc

SEQ ID NO: 1970 - RNA, 20 nt, Artificial Sequence
  synthesized
cagcugguaggggucuuuuc

SEQ ID NO: 1971 - RNA, 20 nt, Artificial Sequence
  synthesized
ccacgcccagcugguaggag

SEQ ID NO: 1972 - RNA, 20 nt, Artificial Sequence
  synthesized
ccacgcccagcugguagggg

SEQ ID NO: 1973 - RNA, 20 nt, Artificial Sequence
  synthesized
ccagcugguaggagucuuuu

SEQ ID NO: 1974 - RNA, 20 nt, Artificial Sequence
  synthesized
ccagcugguaggggucuuuu

SEQ ID NO: 1975 - RNA, 20 nt, Artificial Sequence
  synthesized
cccagcugguaggagucuuu

SEQ ID NO: 1976 - RNA, 20 nt, Artificial Sequence
  synthesized
cccagcugguaggggucuuu

SEQ ID NO: 1977 - RNA, 20 nt, Artificial Sequence
  synthesized
cgcccagcugguaggagucu

SEQ ID NO: 1978 - RNA, 20 nt, Artificial Sequence
  synthesized
cgcccagcugguaggggucu

SEQ ID NO: 1979 - RNA, 20 nt, Artificial Sequence
  synthesized
cugguaggagucuuuucaau

SEQ ID NO: 1980 - RNA, 20 nt, Artificial Sequence
  synthesized
cugguaggggucuuuucaau

SEQ ID NO: 1981 - RNA, 20 nt, Artificial Sequence
  synthesized
gagggauugaaaagaccccu

SEQ ID NO: 1982 - RNA, 20 nt, Artificial Sequence
  synthesized
gagggauugaaaagacuccu

SEQ ID NO: 1983 - RNA, 20 nt, Artificial Sequence
  synthesized
gagucuuuucaaucccuccc

SEQ ID NO: 1984 - RNA, 20 nt, Artificial Sequence
  synthesized
gauugaaaagaccccuacca

SEQ ID NO: 1985 - RNA, 20 nt, Artificial Sequence
  synthesized
gauugaaaagacuccuacca

SEQ ID NO: 1986 - RNA, 20 nt, Artificial Sequence
  synthesized
gcugguaggagucuuuucaa

SEQ ID NO: 1987 - RNA, 20 nt, Artificial Sequence
  synthesized
gcugguaggggucuuuucaa

SEQ ID NO: 1988 - RNA, 20 nt, Artificial Sequence
  synthesized
ggagggauugaaaagacccc

SEQ ID NO: 1989 - RNA, 20 nt, Artificial Sequence
  synthesized
ggagggauugaaaagacucc

SEQ ID NO: 1990 - RNA, 20 nt, Artificial Sequence
  synthesized
ggagucuuuucaaucccucc

SEQ ID NO: 1991 - RNA, 20 nt, Artificial Sequence
  synthesized
ggauugaaaagaccccuacc

SEQ ID NO: 1992 - RNA, 20 nt, Artificial Sequence
  synthesized
ggauugaaaagacuccuacc

SEQ ID NO: 1993 - RNA, 20 nt, Artificial Sequence
  synthesized
gggagggauugaaaagaccc

SEQ ID NO: 1994 - RNA, 20 nt, Artificial Sequence
  synthesized
gggagggauugaaaagacuc

SEQ ID NO: 1995 - RNA, 20 nt, Artificial Sequence
  synthesized
gggauugaaaagaccccuac

SEQ ID NO: 1996 - RNA, 20 nt, Artificial Sequence
  synthesized
gggauugaaaagacuccuac

SEQ ID NO: 1997 - RNA, 20 nt, Artificial Sequence
  synthesized
ggggucuuuucaaucccucc

SEQ ID NO: 1998 - RNA, 20 nt, Artificial Sequence
  synthesized
gggucuuuucaaucccuccc

SEQ ID NO: 1999 - RNA, 20 nt, Artificial Sequence
  synthesized
gguaggagucuuuucaaucc

SEQ ID NO: 2000 - RNA, 20 nt, Artificial Sequence
  synthesized
gguaggggucuuuucaaucc

SEQ ID NO: 2001 - RNA, 20 nt, Artificial Sequence
  synthesized
ggucuuuucaaucccucccu

SEQ ID NO: 2002 - RNA, 20 nt, Artificial Sequence
  synthesized
guaggagucuuuucaauccc

SEQ ID NO: 2003 - RNA, 20 nt, Artificial Sequence
  synthesized
guaggggucuuuucaauccc

SEQ ID NO: 2004 - RNA, 20 nt, Artificial Sequence
  synthesized
uaggagucuuuucaaucccu

SEQ ID NO: 2005 - RNA, 20 nt, Artificial Sequence
  synthesized
uaggggucuuuucaaucccu

SEQ ID NO: 2006 - RNA, 20 nt, Artificial Sequence
  synthesized
ugguaggagucuuuucaauc

SEQ ID NO: 2007 - RNA, 20 nt, Artificial Sequence
  synthesized
ugguaggggucuuuucaauc

SEQ ID NO: 2008 - RNA, 20 nt, Artificial Sequence
  synthesized
aaccugugggcagggaggga

SEQ ID NO: 2009 - RNA, 20 nt, Artificial Sequence
  synthesized
aacuugugggcagggaggga

SEQ ID NO: 2010 - RNA, 20 nt, Artificial Sequence
  synthesized
aaguugguauuggugccccu

SEQ ID NO: 2011 - RNA, 20 nt, Artificial Sequence
  synthesized
aauaccaaccugugggcagg

SEQ ID NO: 2012 - RNA, 20 nt, Artificial Sequence
  synthesized
aauaccaacuugugggcagg

SEQ ID NO: 2013 - RNA, 20 nt, Artificial Sequence
  synthesized
acaaguugguauuggugccc

SEQ ID NO: 2014 - RNA, 20 nt, Artificial Sequence
  synthesized
acagguugguauuggugccc

SEQ ID NO: 2015 - RNA, 20 nt, Artificial Sequence
  synthesized
accugugggcagggagggac

SEQ ID NO: 2016 - RNA, 20 nt, Artificial Sequence
  synthesized
acuugugggcagggagggac

SEQ ID NO: 2017 - RNA, 20 nt, Artificial Sequence
  synthesized
agguugguauuggugccccu

SEQ ID NO: 2018 - RNA, 20 nt, Artificial Sequence
  synthesized
aguugguauuggugccccuc

SEQ ID NO: 2019 - RNA, 20 nt, Artificial Sequence
  synthesized
caaccugugggcagggaggg

SEQ ID NO: 2020 - RNA, 20 nt, Artificial Sequence
  synthesized
caacuugugggcagggaggg

SEQ ID NO: 2021 - RNA, 20 nt, Artificial Sequence
  synthesized
caaguugguauuggugcccc

SEQ ID NO: 2022 - RNA, 20 nt, Artificial Sequence
  synthesized
cacaaguugguauuggugcc

SEQ ID NO: 2023 - RNA, 20 nt, Artificial Sequence
  synthesized
cacagguugguauuggugcc

SEQ ID NO: 2024 - RNA, 20 nt, Artificial Sequence
  synthesized
caccaauaccaaccuguggg

SEQ ID NO: 2025 - RNA, 20 nt, Artificial Sequence
  synthesized
caccaauaccaacuuguggg

SEQ ID NO: 2026 - RNA, 20 nt, Artificial Sequence
  synthesized
cagguugguauuggugcccc

SEQ ID NO: 2027 - RNA, 20 nt, Artificial Sequence
  synthesized
ccaaccugugggcagggagg

SEQ ID NO: 2028 - RNA, 20 nt, Artificial Sequence
  synthesized
ccaacuugugggcagggagg

SEQ ID NO: 2029 - RNA, 20 nt, Artificial Sequence
  synthesized
ccacaaguugguauuggugc

SEQ ID NO: 2030 - RNA, 20 nt, Artificial Sequence
  synthesized
ccacagguugguauuggugc

SEQ ID NO: 2031 - RNA, 20 nt, Artificial Sequence
  synthesized
cccacaaguugguauuggug

SEQ ID NO: 2032 - RNA, 20 nt, Artificial Sequence
  synthesized
cccacagguugguauuggug

SEQ ID NO: 2033 - RNA, 20 nt, Artificial Sequence
  synthesized
cccucccugcccacaaguug

SEQ ID NO: 2034 - RNA, 20 nt, Artificial Sequence
  synthesized
cccucccugcccacagguug

SEQ ID NO: 2035 - RNA, 20 nt, Artificial Sequence
  synthesized
ccucccugcccacaaguugg

SEQ ID NO: 2036 - RNA, 20 nt, Artificial Sequence
  synthesized
ccucccugcccacagguugg

SEQ ID NO: 2037 - RNA, 20 nt, Artificial Sequence
  synthesized
ccugugggcagggagggaca

SEQ ID NO: 2038 - RNA, 20 nt, Artificial Sequence
  synthesized
cucccugcccacaaguuggu

SEQ ID NO: 2039 - RNA, 20 nt, Artificial Sequence
  synthesized
cucccugcccacagguuggu

SEQ ID NO: 2040 - RNA, 20 nt, Artificial Sequence
  synthesized
cugcccacaaguugguauug

SEQ ID NO: 2041 - RNA, 20 nt, Artificial Sequence
  synthesized
cugcccacagguugguauug

SEQ ID NO: 2042 - RNA, 20 nt, Artificial Sequence
  synthesized
cugugggcagggagggacac

SEQ ID NO: 2043 - RNA, 20 nt, Artificial Sequence
  synthesized
cuugugggcagggagggaca

SEQ ID NO: 2044 - RNA, 20 nt, Artificial Sequence
  synthesized
gcaccaauaccaaccugugg

SEQ ID NO: 2045 - RNA, 20 nt, Artificial Sequence
  synthesized
gcaccaauaccaacuugugg

SEQ ID NO: 2046 - RNA, 20 nt, Artificial Sequence
  synthesized
gcccacaaguugguauuggu

SEQ ID NO: 2047 - RNA, 20 nt, Artificial Sequence
  synthesized
gcccacagguugguauuggu

SEQ ID NO: 2048 - RNA, 20 nt, Artificial Sequence
  synthesized
ggcaccaauaccaaccugug

SEQ ID NO: 2049 - RNA, 20 nt, Artificial Sequence
  synthesized
ggcaccaauaccaacuugug

SEQ ID NO: 2050 - RNA, 20 nt, Artificial Sequence
  synthesized
gguugguauuggugccccuc

SEQ ID NO: 2051 - RNA, 20 nt, Artificial Sequence
  synthesized
ucccucccugcccacaaguu

SEQ ID NO: 2052 - RNA, 20 nt, Artificial Sequence
  synthesized
ucccucccugcccacagguu

SEQ ID NO: 2053 - RNA, 20 nt, Artificial Sequence
  synthesized
ucccugcccacaaguuggua

SEQ ID NO: 2054 - RNA, 20 nt, Artificial Sequence
  synthesized
ucccugcccacagguuggua

SEQ ID NO: 2055 - RNA, 20 nt, Artificial Sequence
  synthesized
ugcccacaaguugguauugg

SEQ ID NO: 2056 - RNA, 20 nt, Artificial Sequence
  synthesized
ugcccacagguugguauugg

SEQ ID NO: 2057 - RNA, 20 nt, Artificial Sequence
  synthesized
ugucccucccugcccacaag

SEQ ID NO: 2058 - RNA, 20 nt, Artificial Sequence
  synthesized
ugucccucccugcccacagg

SEQ ID NO: 2059 - RNA, 20 nt, Artificial Sequence
  synthesized
uugugggcagggagggacac

SEQ ID NO: 2060 - RNA, 20 nt, Artificial Sequence
  synthesized
aaaaaaaacccugccuggcc

SEQ ID NO: 2061 - RNA, 20 nt, Artificial Sequence
  synthesized
aaaaaaacccugccuggccg

SEQ ID NO: 2062 - RNA, 20 nt, Artificial Sequence
  synthesized
aaaaaaacccugccuggcug

SEQ ID NO: 2063 - RNA, 20 nt, Artificial Sequence
  synthesized
aaaaaacccugccuggccgg

SEQ ID NO: 2064 - RNA, 20 nt, Artificial Sequence
  synthesized
aaaaaacccugccuggcugg

SEQ ID NO: 2065 - RNA, 20 nt, Artificial Sequence
  synthesized
aacccugccuggccggcaag

SEQ ID NO: 2066 - RNA, 20 nt, Artificial Sequence
  synthesized
aaggagauccuugccagcca

SEQ ID NO: 2067 - RNA, 20 nt, Artificial Sequence
  synthesized
aaggagauccuugccggcca

SEQ ID NO: 2068 - RNA, 20 nt, Artificial Sequence
  synthesized
acaaggagauccuugccggc

SEQ ID NO: 2069 - RNA, 20 nt, Artificial Sequence
  synthesized
acccugccuggccggcaagg

SEQ ID NO: 2070 - RNA, 20 nt, Artificial Sequence
  synthesized
aggagauccuugccagccag

SEQ ID NO: 2071 - RNA, 20 nt, Artificial Sequence
  synthesized
aggagauccuugccggccag

SEQ ID NO: 2072 - RNA, 20 nt, Artificial Sequence
  synthesized
auccuugccggccaggcagg

SEQ ID NO: 2073 - RNA, 20 nt, Artificial Sequence
  synthesized
ccagccaggcaggguuuuuu

SEQ ID NO: 2074 - RNA, 20 nt, Artificial Sequence
  synthesized
cccugccuggccggcaagga

SEQ ID NO: 2075 - RNA, 20 nt, Artificial Sequence
  synthesized
ccggcaaggaucuccuuguc

SEQ ID NO: 2076 - RNA, 20 nt, Artificial Sequence
  synthesized
ccggccaggcaggguuuuuu

SEQ ID NO: 2077 - RNA, 20 nt, Artificial Sequence
  synthesized
ccugccuggccggcaaggau

SEQ ID NO: 2078 - RNA, 20 nt, Artificial Sequence
  synthesized
ccugccuggcuggcaaggau

SEQ ID NO: 2079 - RNA, 20 nt, Artificial Sequence
  synthesized
ccuggccggcaaggaucucc

SEQ ID NO: 2080 - RNA, 20 nt, Artificial Sequence
  synthesized
ccuugccagccaggcagggu

SEQ ID NO: 2081 - RNA, 20 nt, Artificial Sequence
  synthesized
ccuugccggccaggcagggu

SEQ ID NO: 2082 - RNA, 20 nt, Artificial Sequence
  synthesized
cggccaggcaggguuuuuuu

SEQ ID NO: 2083 - RNA, 20 nt, Artificial Sequence
  synthesized
cugccuggccggcaaggauc

SEQ ID NO: 2084 - RNA, 20 nt, Artificial Sequence
  synthesized
cugccuggcuggcaaggauc

SEQ ID NO: 2085 - RNA, 20 nt, Artificial Sequence
  synthesized
cuggcaaggaucuccuuguc

SEQ ID NO: 2086 - RNA, 20 nt, Artificial Sequence
  synthesized
cuggccggcaaggaucuccu

SEQ ID NO: 2087 - RNA, 20 nt, Artificial Sequence
  synthesized
cuggcuggcaaggaucuccu

SEQ ID NO: 2088 - RNA, 20 nt, Artificial Sequence
  synthesized
cuugccagccaggcaggguu

SEQ ID NO: 2089 - RNA, 20 nt, Artificial Sequence
  synthesized
cuugccggccaggcaggguu

SEQ ID NO: 2090 - RNA, 20 nt, Artificial Sequence
  synthesized
gauccuugccggccaggcag

SEQ ID NO: 2091 - RNA, 20 nt, Artificial Sequence
  synthesized
gccagccaggcaggguuuuu

SEQ ID NO: 2092 - RNA, 20 nt, Artificial Sequence
  synthesized
gccggcaaggaucuccuugu

SEQ ID NO: 2093 - RNA, 20 nt, Artificial Sequence
  synthesized
gccggccaggcaggguuuuu

SEQ ID NO: 2094 - RNA, 20 nt, Artificial Sequence
  synthesized
gccuggccggcaaggaucuc

SEQ ID NO: 2095 - RNA, 20 nt, Artificial Sequence
  synthesized
gccuggcuggcaaggaucuc

SEQ ID NO: 2096 - RNA, 20 nt, Artificial Sequence
  synthesized
gcuggcaaggaucuccuugu

SEQ ID NO: 2097 - RNA, 20 nt, Artificial Sequence
  synthesized
ggacaaggagauccuugcca

SEQ ID NO: 2098 - RNA, 20 nt, Artificial Sequence
  synthesized
ggacaaggagauccuugccg

SEQ ID NO: 2099 - RNA, 20 nt, Artificial Sequence
  synthesized
ggagauccuugccagccagg

SEQ ID NO: 2100 - RNA, 20 nt, Artificial Sequence
  synthesized
ggagauccuugccggccagg

SEQ ID NO: 2101 - RNA, 20 nt, Artificial Sequence
  synthesized
ggccggcaaggaucuccuug

SEQ ID NO: 2102 - RNA, 20 nt, Artificial Sequence
  synthesized
ggcuggcaaggaucuccuug

SEQ ID NO: 2103 - RNA, 20 nt, Artificial Sequence
  synthesized
uccuugccagccaggcaggg

SEQ ID NO: 2104 - RNA, 20 nt, Artificial Sequence
  synthesized
uccuugccggccaggcaggg

SEQ ID NO: 2105 - RNA, 20 nt, Artificial Sequence
  synthesized
ugccggccaggcaggguuuu

SEQ ID NO: 2106 - RNA, 20 nt, Artificial Sequence
  synthesized
ugccuggccggcaaggaucu

SEQ ID NO: 2107 - RNA, 20 nt, Artificial Sequence
  synthesized
ugccuggcuggcaaggaucu

SEQ ID NO: 2108 - RNA, 20 nt, Artificial Sequence
  synthesized
uggccggcaaggaucuccuu

SEQ ID NO: 2109 - RNA, 20 nt, Artificial Sequence
  synthesized
uggcuggcaaggaucuccuu

SEQ ID NO: 2110 - RNA, 20 nt, Artificial Sequence
  synthesized
uugccagccaggcaggguuu

SEQ ID NO: 2111 - RNA, 20 nt, Artificial Sequence
  synthesized
uugccggccaggcaggguuu

SEQ ID NO: 2112 - RNA, 20 nt, Artificial Sequence
  synthesized
aaaggugauugaacaccuag

SEQ ID NO: 2113 - RNA, 20 nt, Artificial Sequence
  synthesized
aacggugauugaacaccuag

SEQ ID NO: 2114 - RNA, 20 nt, Artificial Sequence
  synthesized
aaggugauugaacaccuagc

SEQ ID NO: 2115 - RNA, 20 nt, Artificial Sequence
  synthesized
aaucaccuuucacaaugaua

SEQ ID NO: 2116 - RNA, 20 nt, Artificial Sequence
  synthesized
accuuucacaaugauaacag

SEQ ID NO: 2117 - RNA, 20 nt, Artificial Sequence
  synthesized
acggugauugaacaccuagc

SEQ ID NO: 2118 - RNA, 20 nt, Artificial Sequence
  synthesized
agguguucaaucaccuuuca

SEQ ID NO: 2119 - RNA, 20 nt, Artificial Sequence
  synthesized
aucaccuuucacaaugauaa

SEQ ID NO: 2120 - RNA, 20 nt, Artificial Sequence
  synthesized
aucauugugaaaggugauug

SEQ ID NO: 2121 - RNA, 20 nt, Artificial Sequence
  synthesized
auugugaaaggugauugaac

SEQ ID NO: 2122 - RNA, 20 nt, Artificial Sequence
  synthesized
caccuuucacaaugauaaca

SEQ ID NO: 2123 - RNA, 20 nt, Artificial Sequence
  synthesized
cauugugaaaggugauugaa

SEQ ID NO: 2124 - RNA, 20 nt, Artificial Sequence
  synthesized
cggugauugaacaccuagca

SEQ ID NO: 2125 - RNA, 20 nt, Artificial Sequence
  synthesized
cuagguguucaaucaccguu

SEQ ID NO: 2126 - RNA, 20 nt, Artificial Sequence
  synthesized
cuagguguucaaucaccuuu

SEQ ID NO: 2127 - RNA, 20 nt, Artificial Sequence
  synthesized
cuguuaucauugugaaaggu

SEQ ID NO: 2128 - RNA, 20 nt, Artificial Sequence
  synthesized
gaaaggugauugaacaccua

SEQ ID NO: 2129 - RNA, 20 nt, Artificial Sequence
  synthesized
gaacggugauugaacaccua

SEQ ID NO: 2130 - RNA, 20 nt, Artificial Sequence
  synthesized
gcuagguguucaaucaccgu

SEQ ID NO: 2131 - RNA, 20 nt, Artificial Sequence
  synthesized
gcuagguguucaaucaccuu

SEQ ID NO: 2132 - RNA, 20 nt, Artificial Sequence
  synthesized
gugaaaggugauugaacacc

SEQ ID NO: 2133 - RNA, 20 nt, Artificial Sequence
  synthesized
gugaacggugauugaacacc

SEQ ID NO: 2134 - RNA, 20 nt, Artificial Sequence
  synthesized
guguucaaucaccuuucaca

SEQ ID NO: 2135 - RNA, 20 nt, Artificial Sequence
  synthesized
uacuguuaucauugugaaag

SEQ ID NO: 2136 - RNA, 20 nt, Artificial Sequence
  synthesized
uagguguucaaucaccguuc

SEQ ID NO: 2137 - RNA, 20 nt, Artificial Sequence
  synthesized
uagguguucaaucaccuuuc

SEQ ID NO: 2138 - RNA, 20 nt, Artificial Sequence
  synthesized
ucaaucaccuuucacaauga

SEQ ID NO: 2139 - RNA, 20 nt, Artificial Sequence
  synthesized
ucaccuuucacaaugauaac

SEQ ID NO: 2140 - RNA, 20 nt, Artificial Sequence
  synthesized
ucauugugaaaggugauuga

SEQ ID NO: 2141 - RNA, 20 nt, Artificial Sequence
  synthesized
ugaaaggugauugaacaccu

SEQ ID NO: 2142 - RNA, 20 nt, Artificial Sequence
  synthesized
ugaacggugauugaacaccu

SEQ ID NO: 2143 - RNA, 20 nt, Artificial Sequence
  synthesized
ugcuagguguucaaucaccg

SEQ ID NO: 2144 - RNA, 20 nt, Artificial Sequence
  synthesized
ugcuagguguucaaucaccu

SEQ ID NO: 2145 - RNA, 20 nt, Artificial Sequence
  synthesized
ugugaaaggugauugaacac

SEQ ID NO: 2146 - RNA, 20 nt, Artificial Sequence
  synthesized
ugugaacggugauugaacac

SEQ ID NO: 2147 - RNA, 20 nt, Artificial Sequence
  synthesized
uguuaucauugugaaaggug

SEQ ID NO: 2148 - RNA, 20 nt, Artificial Sequence
  synthesized
uucaaucaccuuucacaaug

SEQ ID NO: 2149 - RNA, 20 nt, Artificial Sequence
  synthesized
aacacuaggaugggccacgg

SEQ ID NO: 2150 - RNA, 20 nt, Artificial Sequence
  synthesized
aacacuagggugggccacgg

SEQ ID NO: 2151 - RNA, 20 nt, Artificial Sequence
  synthesized
acccuaguguugguagcugc

SEQ ID NO: 2152 - RNA, 20 nt, Artificial Sequence
  synthesized
acuaggaugggccacgguca

SEQ ID NO: 2153 - RNA, 20 nt, Artificial Sequence
  synthesized
acuagggugggccacgguca

SEQ ID NO: 2154 - RNA, 20 nt, Artificial Sequence
  synthesized
agcuaccaacacuaggaugg

SEQ ID NO: 2155 - RNA, 20 nt, Artificial Sequence
  synthesized
agcuaccaacacuagggugg

SEQ ID NO: 2156 - RNA, 20 nt, Artificial Sequence
  synthesized
aggaugggccacggucacag

SEQ ID NO: 2157 - RNA, 20 nt, Artificial Sequence
  synthesized
agggugggccacggucacag

SEQ ID NO: 2158 - RNA, 20 nt, Artificial Sequence
  synthesized
auccuaguguugguagcugc

SEQ ID NO: 2159 - RNA, 20 nt, Artificial Sequence
  synthesized
augggccacggucacagcaa

SEQ ID NO: 2160 - RNA, 20 nt, Artificial Sequence
  synthesized
caacacuaggaugggccacg

SEQ ID NO: 2161 - RNA, 20 nt, Artificial Sequence
  synthesized
caacacuagggugggccacg

SEQ ID NO: 2162 - RNA, 20 nt, Artificial Sequence
  synthesized
cacccuaguguugguagcug

SEQ ID NO: 2163 - RNA, 20 nt, Artificial Sequence
  synthesized
cacuaggaugggccacgguc

SEQ ID NO: 2164 - RNA, 20 nt, Artificial Sequence
  synthesized
cacuagggugggccacgguc

SEQ ID NO: 2165 - RNA, 20 nt, Artificial Sequence
  synthesized
cagcuaccaacacuaggaug

SEQ ID NO: 2166 - RNA, 20 nt, Artificial Sequence
  synthesized
cagcuaccaacacuagggug

SEQ ID NO: 2167 - RNA, 20 nt, Artificial Sequence
  synthesized
cauccuaguguugguagcug

SEQ ID NO: 2168 - RNA, 20 nt, Artificial Sequence
  synthesized
ccacccuaguguugguagcu

SEQ ID NO: 2169 - RNA, 20 nt, Artificial Sequence
  synthesized
ccauccuaguguugguagcu

SEQ ID NO: 2170 - RNA, 20 nt, Artificial Sequence
  synthesized
cccacccuaguguugguagc

SEQ ID NO: 2171 - RNA, 20 nt, Artificial Sequence
  synthesized
cccauccuaguguugguagc

SEQ ID NO: 2172 - RNA, 20 nt, Artificial Sequence
  synthesized
cccuaguguugguagcugcc

SEQ ID NO: 2173 - RNA, 20 nt, Artificial Sequence
  synthesized
ccguggcccacccuaguguu

SEQ ID NO: 2174 - RNA, 20 nt, Artificial Sequence
  synthesized
ccguggcccauccuaguguu

SEQ ID NO: 2175 - RNA, 20 nt, Artificial Sequence
  synthesized
cguggcccacccuaguguug

SEQ ID NO: 2176 - RNA, 20 nt, Artificial Sequence
  synthesized
cguggcccauccuaguguug

SEQ ID NO: 2177 - RNA, 20 nt, Artificial Sequence
  synthesized
cuaggaugggccacggucac

SEQ ID NO: 2178 - RNA, 20 nt, Artificial Sequence
  synthesized
cuagggugggccacggucac

SEQ ID NO: 2179 - RNA, 20 nt, Artificial Sequence
  synthesized
gaccguggcccacccuagug

SEQ ID NO: 2180 - RNA, 20 nt, Artificial Sequence
  synthesized
gaccguggcccauccuagug

SEQ ID NO: 2181 - RNA, 20 nt, Artificial Sequence
  synthesized
gaugggccacggucacagca

SEQ ID NO: 2182 - RNA, 20 nt, Artificial Sequence
  synthesized
gcccacccuaguguugguag

SEQ ID NO: 2183 - RNA, 20 nt, Artificial Sequence
  synthesized
gcccauccuaguguugguag

SEQ ID NO: 2184 - RNA, 20 nt, Artificial Sequence
  synthesized
gcuaccaacacuaggauggg

SEQ ID NO: 2185 - RNA, 20 nt, Artificial Sequence
  synthesized
gcuaccaacacuaggguggg

SEQ ID NO: 2186 - RNA, 20 nt, Artificial Sequence
  synthesized
gcugugaccguggcccaccc

SEQ ID NO: 2187 - RNA, 20 nt, Artificial Sequence
  synthesized
gcugugaccguggcccaucc

SEQ ID NO: 2188 - RNA, 20 nt, Artificial Sequence
  synthesized
ggaugggccacggucacagc

SEQ ID NO: 2189 - RNA, 20 nt, Artificial Sequence
  synthesized
ggcccacccuaguguuggua

SEQ ID NO: 2190 - RNA, 20 nt, Artificial Sequence
  synthesized
ggcccauccuaguguuggua

SEQ ID NO: 2191 - RNA, 20 nt, Artificial Sequence
  synthesized
gggugggccacggucacagc

SEQ ID NO: 2192 - RNA, 20 nt, Artificial Sequence
  synthesized
ggugggccacggucacagca

SEQ ID NO: 2193 - RNA, 20 nt, Artificial Sequence
  synthesized
gugaccguggcccacccuag

SEQ ID NO: 2194 - RNA, 20 nt, Artificial Sequence
  synthesized
gugaccguggcccauccuag

SEQ ID NO: 2195 - RNA, 20 nt, Artificial Sequence
  synthesized
guggcccacccuaguguugg

SEQ ID NO: 2196 - RNA, 20 nt, Artificial Sequence
  synthesized
guggcccauccuaguguugg

SEQ ID NO: 2197 - RNA, 20 nt, Artificial Sequence
  synthesized
gugggccacggucacagcaa

SEQ ID NO: 2198 - RNA, 20 nt, Artificial Sequence
  synthesized
uaccaacacuaggaugggcc

SEQ ID NO: 2199 - RNA, 20 nt, Artificial Sequence
  synthesized
uaccaacacuagggugggcc

SEQ ID NO: 2200 - RNA, 20 nt, Artificial Sequence
  synthesized
uaggaugggccacggucaca

SEQ ID NO: 2201 - RNA, 20 nt, Artificial Sequence
  synthesized
uagggugggccacggucaca

SEQ ID NO: 2202 - RNA, 20 nt, Artificial Sequence
  synthesized
uccuaguguugguagcugcc

SEQ ID NO: 2203 - RNA, 20 nt, Artificial Sequence
  synthesized
ugcugugaccguggcccacc

SEQ ID NO: 2204 - RNA, 20 nt, Artificial Sequence
  synthesized
ugcugugaccguggcccauc

SEQ ID NO: 2205 - RNA, 20 nt, Artificial Sequence
  synthesized
uggcccacccuaguguuggu

SEQ ID NO: 2206 - RNA, 20 nt, Artificial Sequence
  synthesized
uggcccauccuaguguuggu

SEQ ID NO: 2207 - RNA, 20 nt, Artificial Sequence
  synthesized
ugugaccguggcccacccua

SEQ ID NO: 2208 - RNA, 20 nt, Artificial Sequence
  synthesized
ugugaccguggcccauccua

SEQ ID NO: 2209 - RNA, 20 nt, Artificial Sequence
  synthesized
uugcugugaccguggcccac

SEQ ID NO: 2210 - RNA, 20 nt, Artificial Sequence
  synthesized
uugcugugaccguggcccau

SEQ ID NO: 2211 - RNA, 20 nt, Artificial Sequence
  synthesized
accugcccaauccccagcac

SEQ ID NO: 2212 - RNA, 20 nt, Artificial Sequence
  synthesized
agcccucaccugcccaaucc

SEQ ID NO: 2213 - RNA, 20 nt, Artificial Sequence
  synthesized
agcccucgccugcccaaucc

SEQ ID NO: 2214 - RNA, 20 nt, Artificial Sequence
  synthesized
agcuuccagcccucaccugc

SEQ ID NO: 2215 - RNA, 20 nt, Artificial Sequence
  synthesized
agcuuccagcccucgccugc

SEQ ID NO: 2216 - RNA, 20 nt, Artificial Sequence
  synthesized
auugggcaggcgagggcugg

SEQ ID NO: 2217 - RNA, 20 nt, Artificial Sequence
  synthesized
caccugcccaauccccagca

SEQ ID NO: 2218 - RNA, 20 nt, Artificial Sequence
  synthesized
ccagcccucgccugcccaau

SEQ ID NO: 2219 - RNA, 20 nt, Artificial Sequence
  synthesized
ccagcuuccagcccucgccu

SEQ ID NO: 2220 - RNA, 20 nt, Artificial Sequence
  synthesized
cccagcuuccagcccucacc

SEQ ID NO: 2221 - RNA, 20 nt, Artificial Sequence
  synthesized
cccagcuuccagcccucgcc

SEQ ID NO: 2222 - RNA, 20 nt, Artificial Sequence
  synthesized
ccccagcuuccagcccucac

SEQ ID NO: 2223 - RNA, 20 nt, Artificial Sequence
  synthesized
ccccagcuuccagcccucgc

SEQ ID NO: 2224 - RNA, 20 nt, Artificial Sequence
  synthesized
cccccagcuuccagcccuca

SEQ ID NO: 2225 - RNA, 20 nt, Artificial Sequence
  synthesized
cccccagcuuccagcccucg

SEQ ID NO: 2226 - RNA, 20 nt, Artificial Sequence
  synthesized
cccucaccugcccaaucccc

SEQ ID NO: 2227 - RNA, 20 nt, Artificial Sequence
  synthesized
cccucgccugcccaaucccc

SEQ ID NO: 2228 - RNA, 20 nt, Artificial Sequence
  synthesized
ccucgccugcccaaucccca

SEQ ID NO: 2229 - RNA, 20 nt, Artificial Sequence
  synthesized
cgccugcccaauccccagca

SEQ ID NO: 2230 - RNA, 20 nt, Artificial Sequence
  synthesized
cucaccugcccaauccccag

SEQ ID NO: 2231 - RNA, 20 nt, Artificial Sequence
  synthesized
cucgccugcccaauccccag

SEQ ID NO: 2232 - RNA, 20 nt, Artificial Sequence
  synthesized
cuggggauugggcaggcgag

SEQ ID NO: 2233 - RNA, 20 nt, Artificial Sequence
  synthesized
cuggggauugggcaggugag

SEQ ID NO: 2234 - RNA, 20 nt, Artificial Sequence
  synthesized
cuuccagcccucgccugccc

SEQ ID NO: 2235 - RNA, 20 nt, Artificial Sequence
  synthesized
gauugggcaggcgagggcug

SEQ ID NO: 2236 - RNA, 20 nt, Artificial Sequence
  synthesized
gccugcccaauccccagcac

SEQ ID NO: 2237 - RNA, 20 nt, Artificial Sequence
  synthesized
gcuuccagcccucgccugcc

SEQ ID NO: 2238 - RNA, 20 nt, Artificial Sequence
  synthesized
gggcaggcgagggcuggaag

SEQ ID NO: 2239 - RNA, 20 nt, Artificial Sequence
  synthesized
ggggauugggcaggcgaggg

SEQ ID NO: 2240 - RNA, 20 nt, Artificial Sequence
  synthesized
gugcuggggauugggcaggc

SEQ ID NO: 2241 - RNA, 20 nt, Artificial Sequence
  synthesized
ucaccugcccaauccccagc

SEQ ID NO: 2242 - RNA, 20 nt, Artificial Sequence
  synthesized
uccagcccucgccugcccaa

SEQ ID NO: 2243 - RNA, 20 nt, Artificial Sequence
  synthesized
ucgccugcccaauccccagc

SEQ ID NO: 2244 - RNA, 20 nt, Artificial Sequence
  synthesized
ugggcaggcgagggcuggaa

SEQ ID NO: 2245 - RNA, 20 nt, Artificial Sequence
  synthesized
ugggcaggugagggcuggaa

SEQ ID NO: 2246 - RNA, 20 nt, Artificial Sequence
  synthesized
uggggauugggcaggcgagg

SEQ ID NO: 2247 - RNA, 20 nt, Artificial Sequence
  synthesized
uuccagcccucgccugccca

SEQ ID NO: 2248 - RNA, 20 nt, Artificial Sequence
  synthesized
uugggcaggcgagggcugga

SEQ ID NO: 2249 - RNA, 20 nt, Artificial Sequence
  synthesized
uugggcaggugagggcugga

SEQ ID NO: 2250 - RNA, 20 nt, Artificial Sequence
  synthesized
aaauaucuuggggacuggga

SEQ ID NO: 2251 - RNA, 20 nt, Artificial Sequence
  synthesized
aaaugucuuggggacuggga

SEQ ID NO: 2252 - RNA, 20 nt, Artificial Sequence
  synthesized
aagacauuugugcagacuuu

SEQ ID NO: 2253 - RNA, 20 nt, Artificial Sequence
  synthesized
aagauauuugugcagacuuu

SEQ ID NO: 2254 - RNA, 20 nt, Artificial Sequence
  synthesized
aauaucuuggggacugggau

SEQ ID NO: 2255 - RNA, 20 nt, Artificial Sequence
  synthesized
aaugucuuggggacugggau

SEQ ID NO: 2256 - RNA, 20 nt, Artificial Sequence
  synthesized
acaaauaucuuggggacugg

SEQ ID NO: 2257 - RNA, 20 nt, Artificial Sequence
  synthesized
acaaaugucuuggggacugg

SEQ ID NO: 2258 - RNA, 20 nt, Artificial Sequence
  synthesized
agacauuugugcagacuuug

SEQ ID NO: 2259 - RNA, 20 nt, Artificial Sequence
  synthesized
agauauuugugcagacuuug

SEQ ID NO: 2260 - RNA, 20 nt, Artificial Sequence
  synthesized
agcaaagucugcacaaauau

SEQ ID NO: 2261 - RNA, 20 nt, Artificial Sequence
  synthesized
agcaaagucugcacaaaugu

SEQ ID NO: 2262 - RNA, 20 nt, Artificial Sequence
  synthesized
auaucuuggggacugggauc

SEQ ID NO: 2263 - RNA, 20 nt, Artificial Sequence
  synthesized
auauuugugcagacuuugcu

SEQ ID NO: 2264 - RNA, 20 nt, Artificial Sequence
  synthesized
aucuuggggacugggaucca

SEQ ID NO: 2265 - RNA, 20 nt, Artificial Sequence
  synthesized
augucuuggggacugggauc

SEQ ID NO: 2266 - RNA, 20 nt, Artificial Sequence
  synthesized
caaauaucuuggggacuggg

SEQ ID NO: 2267 - RNA, 20 nt, Artificial Sequence
  synthesized
caaaugucuuggggacuggg

SEQ ID NO: 2268 - RNA, 20 nt, Artificial Sequence
  synthesized
caagacauuugugcagacuu

SEQ ID NO: 2269 - RNA, 20 nt, Artificial Sequence
  synthesized
caagauauuugugcagacuu

SEQ ID NO: 2270 - RNA, 20 nt, Artificial Sequence
  synthesized
caguccccaagacauuugug

SEQ ID NO: 2271 - RNA, 20 nt, Artificial Sequence
  synthesized
caguccccaagauauuugug

SEQ ID NO: 2272 - RNA, 20 nt, Artificial Sequence
  synthesized
cauuugugcagacuuugcua

SEQ ID NO: 2273 - RNA, 20 nt, Artificial Sequence
  synthesized
ccaagacauuugugcagacu

SEQ ID NO: 2274 - RNA, 20 nt, Artificial Sequence
  synthesized
ccaagauauuugugcagacu

SEQ ID NO: 2275 - RNA, 20 nt, Artificial Sequence
  synthesized
ccaguccccaagacauuugu

SEQ ID NO: 2276 - RNA, 20 nt, Artificial Sequence
  synthesized
ccaguccccaagauauuugu

SEQ ID NO: 2277 - RNA, 20 nt, Artificial Sequence
  synthesized
cccaagacauuugugcagac

SEQ ID NO: 2278 - RNA, 20 nt, Artificial Sequence
  synthesized
cccaagauauuugugcagac

SEQ ID NO: 2279 - RNA, 20 nt, Artificial Sequence
  synthesized
cccaguccccaagacauuug

SEQ ID NO: 2280 - RNA, 20 nt, Artificial Sequence
  synthesized
cccaguccccaagauauuug

SEQ ID NO: 2281 - RNA, 20 nt, Artificial Sequence
  synthesized
ccccaagacauuugugcaga

SEQ ID NO: 2282 - RNA, 20 nt, Artificial Sequence
  synthesized
ccccaagauauuugugcaga

SEQ ID NO: 2283 - RNA, 20 nt, Artificial Sequence
  synthesized
cugcacaaauaucuugggga

SEQ ID NO: 2284 - RNA, 20 nt, Artificial Sequence
  synthesized
cugcacaaaugucuugggga

SEQ ID NO: 2285 - RNA, 20 nt, Artificial Sequence
  synthesized
gacauuugugcagacuuugc

SEQ ID NO: 2286 - RNA, 20 nt, Artificial Sequence
  synthesized
gaucccaguccccaagacau

SEQ ID NO: 2287 - RNA, 20 nt, Artificial Sequence
  synthesized
gaucccaguccccaagauau

SEQ ID NO: 2288 - RNA, 20 nt, Artificial Sequence
  synthesized
gcaaagucugcacaaauauc

SEQ ID NO: 2289 - RNA, 20 nt, Artificial Sequence
  synthesized
gcaaagucugcacaaauguc

SEQ ID NO: 2290 - RNA, 20 nt, Artificial Sequence
  synthesized
ggaucccaguccccaagaca

SEQ ID NO: 2291 - RNA, 20 nt, Artificial Sequence
  synthesized
ggaucccaguccccaagaua

SEQ ID NO: 2292 - RNA, 20 nt, Artificial Sequence
  synthesized
guccccaagacauuugugca

SEQ ID NO: 2293 - RNA, 20 nt, Artificial Sequence
  synthesized
guccccaagauauuugugca

SEQ ID NO: 2294 - RNA, 20 nt, Artificial Sequence
  synthesized
gucugcacaaauaucuuggg

SEQ ID NO: 2295 - RNA, 20 nt, Artificial Sequence
  synthesized
gucugcacaaaugucuuggg

SEQ ID NO: 2296 - RNA, 20 nt, Artificial Sequence
  synthesized
gucuuggggacugggaucca

SEQ ID NO: 2297 - RNA, 20 nt, Artificial Sequence
  synthesized
uagcaaagucugcacaaaua

SEQ ID NO: 2298 - RNA, 20 nt, Artificial Sequence
  synthesized
uagcaaagucugcacaaaug

SEQ ID NO: 2299 - RNA, 20 nt, Artificial Sequence
  synthesized
uaucuuggggacugggaucc

SEQ ID NO: 2300 - RNA, 20 nt, Artificial Sequence
  synthesized
ucccaguccccaagauauuu

SEQ ID NO: 2301 - RNA, 20 nt, Artificial Sequence
  synthesized
uccccaagacauuugugcag

SEQ ID NO: 2302 - RNA, 20 nt, Artificial Sequence
  synthesized
uccccaagauauuugugcag

SEQ ID NO: 2303 - RNA, 20 nt, Artificial Sequence
  synthesized
ucugcacaaauaucuugggg

SEQ ID NO: 2304 - RNA, 20 nt, Artificial Sequence
  synthesized
ucugcacaaaugucuugggg

SEQ ID NO: 2305 - RNA, 20 nt, Artificial Sequence
  synthesized
uggaucccaguccccaagac

SEQ ID NO: 2306 - RNA, 20 nt, Artificial Sequence
  synthesized
uggaucccaguccccaagau

SEQ ID NO: 2307 - RNA, 20 nt, Artificial Sequence
  synthesized
ugucuuggggacugggaucc

SEQ ID NO: 2308 - RNA, 20 nt, Artificial Sequence
  synthesized
aaggcagguauuagcauggc

SEQ ID NO: 2309 - RNA, 20 nt, Artificial Sequence
  synthesized
aaggcagguauuagcauggg

SEQ ID NO: 2310 - RNA, 20 nt, Artificial Sequence
  synthesized
agcauggcauggcagcaggg

SEQ ID NO: 2311 - RNA, 20 nt, Artificial Sequence
  synthesized
agcaugggauggcagcaggg

SEQ ID NO: 2312 - RNA, 20 nt, Artificial Sequence
  synthesized
agcucccugcugccauccca

SEQ ID NO: 2313 - RNA, 20 nt, Artificial Sequence
  synthesized
agcucccugcugccaugcca

SEQ ID NO: 2314 - RNA, 20 nt, Artificial Sequence
  synthesized
aggcagguauuagcauggca

SEQ ID NO: 2315 - RNA, 20 nt, Artificial Sequence
  synthesized
aggcagguauuagcauggga

SEQ ID NO: 2316 - RNA, 20 nt, Artificial Sequence
  synthesized
agguauuagcauggcauggc

SEQ ID NO: 2317 - RNA, 20 nt, Artificial Sequence
  synthesized
agguauuagcaugggauggc

SEQ ID NO: 2318 - RNA, 20 nt, Artificial Sequence
  synthesized
aucccaugcuaauaccugcc

SEQ ID NO: 2319 - RNA, 20 nt, Artificial Sequence
  synthesized
augccaugcuaauaccugcc

SEQ ID NO: 2320 - RNA, 20 nt, Artificial Sequence
  synthesized
auggcauggcagcagggagc

SEQ ID NO: 2321 - RNA, 20 nt, Artificial Sequence
  synthesized
augggauggcagcagggagc

SEQ ID NO: 2322 - RNA, 20 nt, Artificial Sequence
  synthesized
auuagcaugggauggcagca

SEQ ID NO: 2323 - RNA, 20 nt, Artificial Sequence
  synthesized
cagcucccugcugccauccc

SEQ ID NO: 2324 - RNA, 20 nt, Artificial Sequence
  synthesized
cagcucccugcugccaugcc

SEQ ID NO: 2325 - RNA, 20 nt, Artificial Sequence
  synthesized
cagguauuagcauggcaugg

SEQ ID NO: 2326 - RNA, 20 nt, Artificial Sequence
  synthesized
cagguauuagcaugggaugg

SEQ ID NO: 2327 - RNA, 20 nt, Artificial Sequence
  synthesized
caucccaugcuaauaccugc

SEQ ID NO: 2328 - RNA, 20 nt, Artificial Sequence
  synthesized
caugccaugcuaauaccugc

SEQ ID NO: 2329 - RNA, 20 nt, Artificial Sequence
  synthesized
cauggcagcagggagcugag

SEQ ID NO: 2330 - RNA, 20 nt, Artificial Sequence
  synthesized
cauggcauggcagcagggag

SEQ ID NO: 2331 - RNA, 20 nt, Artificial Sequence
  synthesized
caugggauggcagcagggag

SEQ ID NO: 2332 - RNA, 20 nt, Artificial Sequence
  synthesized
ccaucccaugcuaauaccug

SEQ ID NO: 2333 - RNA, 20 nt, Artificial Sequence
  synthesized
ccaugccaugcuaauaccug

SEQ ID NO: 2334 - RNA, 20 nt, Artificial Sequence
  synthesized
cccaugcuaauaccugccuu

SEQ ID NO: 2335 - RNA, 20 nt, Artificial Sequence
  synthesized
cccugcugccaucccaugcu

SEQ ID NO: 2336 - RNA, 20 nt, Artificial Sequence
  synthesized
cccugcugccaugccaugcu

SEQ ID NO: 2337 - RNA, 20 nt, Artificial Sequence
  synthesized
ccugcugccaucccaugcua

SEQ ID NO: 2338 - RNA, 20 nt, Artificial Sequence
  synthesized
ccugcugccaugccaugcua

SEQ ID NO: 2339 - RNA, 20 nt, Artificial Sequence
  synthesized
cucagcucccugcugccauc

SEQ ID NO: 2340 - RNA, 20 nt, Artificial Sequence
  synthesized
cucagcucccugcugccaug

SEQ ID NO: 2341 - RNA, 20 nt, Artificial Sequence
  synthesized
cucccugcugccaucccaug

SEQ ID NO: 2342 - RNA, 20 nt, Artificial Sequence
  synthesized
cucccugcugccaugccaug

SEQ ID NO: 2343 - RNA, 20 nt, Artificial Sequence
  synthesized
cugccaucccaugcuaauac

SEQ ID NO: 2344 - RNA, 20 nt, Artificial Sequence
  synthesized
cugccaugccaugcuaauac

SEQ ID NO: 2345 - RNA, 20 nt, Artificial Sequence
  synthesized
cugcugccaucccaugcuaa

SEQ ID NO: 2346 - RNA, 20 nt, Artificial Sequence
  synthesized
cugcugccaugccaugcuaa

SEQ ID NO: 2347 - RNA, 20 nt, Artificial Sequence
  synthesized
gcagguauuagcauggcaug

SEQ ID NO: 2348 - RNA, 20 nt, Artificial Sequence
  synthesized
gcagguauuagcaugggaug

SEQ ID NO: 2349 - RNA, 20 nt, Artificial Sequence
  synthesized
gcauggcagcagggagcuga

SEQ ID NO: 2350 - RNA, 20 nt, Artificial Sequence
  synthesized
gcauggcauggcagcaggga

SEQ ID NO: 2351 - RNA, 20 nt, Artificial Sequence
  synthesized
gcaugggauggcagcaggga

SEQ ID NO: 2352 - RNA, 20 nt, Artificial Sequence
  synthesized
gccaucccaugcuaauaccu

SEQ ID NO: 2353 - RNA, 20 nt, Artificial Sequence
  synthesized
gccaugccaugcuaauaccu

SEQ ID NO: 2354 - RNA, 20 nt, Artificial Sequence
  synthesized
gccaugcuaauaccugccuu

SEQ ID NO: 2355 - RNA, 20 nt, Artificial Sequence
  synthesized
gcucccugcugccaucccau

SEQ ID NO: 2356 - RNA, 20 nt, Artificial Sequence
  synthesized
gcucccugcugccaugccau

SEQ ID NO: 2357 - RNA, 20 nt, Artificial Sequence
  synthesized
gcugccaucccaugcuaaua

SEQ ID NO: 2358 - RNA, 20 nt, Artificial Sequence
  synthesized
gcugccaugccaugcuaaua

SEQ ID NO: 2359 - RNA, 20 nt, Artificial Sequence
  synthesized
ggcagguauuagcauggcau

SEQ ID NO: 2360 - RNA, 20 nt, Artificial Sequence
  synthesized
ggcagguauuagcaugggau

SEQ ID NO: 2361 - RNA, 20 nt, Artificial Sequence
  synthesized
ggcauggcagcagggagcug

SEQ ID NO: 2362 - RNA, 20 nt, Artificial Sequence
  synthesized
gguauuagcauggcauggca

SEQ ID NO: 2363 - RNA, 20 nt, Artificial Sequence
  synthesized
gguauuagcaugggauggca

SEQ ID NO: 2364 - RNA, 20 nt, Artificial Sequence
  synthesized
guauuagcauggcauggcag

SEQ ID NO: 2365 - RNA, 20 nt, Artificial Sequence
  synthesized
guauuagcaugggauggcag

SEQ ID NO: 2366 - RNA, 20 nt, Artificial Sequence
  synthesized
uagcauggcauggcagcagg

SEQ ID NO: 2367 - RNA, 20 nt, Artificial Sequence
  synthesized
uagcaugggauggcagcagg

SEQ ID NO: 2368 - RNA, 20 nt, Artificial Sequence
  synthesized
uauuagcauggcauggcagc

SEQ ID NO: 2369 - RNA, 20 nt, Artificial Sequence
  synthesized
uauuagcaugggauggcagc

SEQ ID NO: 2370 - RNA, 20 nt, Artificial Sequence
  synthesized
ucagcucccugcugccaucc

SEQ ID NO: 2371 - RNA, 20 nt, Artificial Sequence
  synthesized
ucagcucccugcugccaugc

SEQ ID NO: 2372 - RNA, 20 nt, Artificial Sequence
  synthesized
ucccaugcuaauaccugccu

SEQ ID NO: 2373 - RNA, 20 nt, Artificial Sequence
  synthesized
ucccugcugccaucccaugc

SEQ ID NO: 2374 - RNA, 20 nt, Artificial Sequence
  synthesized
ugccaucccaugcuaauacc

SEQ ID NO: 2375 - RNA, 20 nt, Artificial Sequence
  synthesized
ugccaugccaugcuaauacc

SEQ ID NO: 2376 - RNA, 20 nt, Artificial Sequence
  synthesized
ugccaugcuaauaccugccu

SEQ ID NO: 2377 - RNA, 20 nt, Artificial Sequence
  synthesized
ugcugccaucccaugcuaau

SEQ ID NO: 2378 - RNA, 20 nt, Artificial Sequence
  synthesized
ugcugccaugccaugcuaau

SEQ ID NO: 2379 - RNA, 20 nt, Artificial Sequence
  synthesized
uggcauggcagcagggagcu

SEQ ID NO: 2380 - RNA, 20 nt, Artificial Sequence
  synthesized
ugggauggcagcagggagcu

SEQ ID NO: 2381 - RNA, 20 nt, Artificial Sequence
  synthesized
uuagcauggcauggcagcag

SEQ ID NO: 2382 - RNA, 20 nt, Artificial Sequence
  synthesized
uuagcaugggauggcagcag

SEQ ID NO: 2383 - RNA, 20 nt, Artificial Sequence
  synthesized
aaaucugagcugcuguccgu

SEQ ID NO: 2384 - RNA, 20 nt, Artificial Sequence
  synthesized
aaaucugagcuucuguccgu

SEQ ID NO: 2385 - RNA, 20 nt, Artificial Sequence
  synthesized
aagcucagauuugauucgga

SEQ ID NO: 2386 - RNA, 20 nt, Artificial Sequence
  synthesized
aaucaaaucugagcugcugu

SEQ ID NO: 2387 - RNA, 20 nt, Artificial Sequence
  synthesized
aaucaaaucugagcuucugu

SEQ ID NO: 2388 - RNA, 20 nt, Artificial Sequence
  synthesized
aaucugagcugcuguccgug

SEQ ID NO: 2389 - RNA, 20 nt, Artificial Sequence
  synthesized
aaucugagcuucuguccgug

SEQ ID NO: 2390 - RNA, 20 nt, Artificial Sequence
  synthesized
accacggacagaagcucaga

SEQ ID NO: 2391 - RNA, 20 nt, Artificial Sequence
  synthesized
accacggacagcagcucaga

SEQ ID NO: 2392 - RNA, 20 nt, Artificial Sequence
  synthesized
acggacagaagcucagauuu

SEQ ID NO: 2393 - RNA, 20 nt, Artificial Sequence
  synthesized
acggacagcagcucagauuu

SEQ ID NO: 2394 - RNA, 20 nt, Artificial Sequence
  synthesized
agaagcucagauuugauucg

SEQ ID NO: 2395 - RNA, 20 nt, Artificial Sequence
  synthesized
agaccacggacagaagcuca

SEQ ID NO: 2396 - RNA, 20 nt, Artificial Sequence
  synthesized
agaccacggacagcagcuca

SEQ ID NO: 2397 - RNA, 20 nt, Artificial Sequence
  synthesized
agcagcucagauuugauucg

SEQ ID NO: 2398 - RNA, 20 nt, Artificial Sequence
  synthesized
agcugcuguccguggucuuc

SEQ ID NO: 2399 - RNA, 20 nt, Artificial Sequence
  synthesized
agcuucuguccguggucuuc

SEQ ID NO: 2400 - RNA, 20 nt, Artificial Sequence
  synthesized
aucugagcugcuguccgugg

SEQ ID NO: 2401 - RNA, 20 nt, Artificial Sequence
  synthesized
aucugagcuucuguccgugg

SEQ ID NO: 2402 - RNA, 20 nt, Artificial Sequence
  synthesized
cagcucagauuugauucgga

SEQ ID NO: 2403 - RNA, 20 nt, Artificial Sequence
  synthesized
ccacggacagaagcucagau

SEQ ID NO: 2404 - RNA, 20 nt, Artificial Sequence
  synthesized
ccacggacagcagcucagau

SEQ ID NO: 2405 - RNA, 20 nt, Artificial Sequence
  synthesized
ccgaaucaaaucugagcuuc

SEQ ID NO: 2406 - RNA, 20 nt, Artificial Sequence
  synthesized
ccgugaagaccacggacaga

SEQ ID NO: 2407 - RNA, 20 nt, Artificial Sequence
  synthesized
ccgugaagaccacggacagc

SEQ ID NO: 2408 - RNA, 20 nt, Artificial Sequence
  synthesized
cgaaucaaaucugagcugcu

SEQ ID NO: 2409 - RNA, 20 nt, Artificial Sequence
  synthesized
cgaaucaaaucugagcuucu

SEQ ID NO: 2410 - RNA, 20 nt, Artificial Sequence
  synthesized
cggacagaagcucagauuug

SEQ ID NO: 2411 - RNA, 20 nt, Artificial Sequence
  synthesized
cggacagcagcucagauuug

SEQ ID NO: 2412 - RNA, 20 nt, Artificial Sequence
  synthesized
cgugaagaccacggacagaa

SEQ ID NO: 2413 - RNA, 20 nt, Artificial Sequence
  synthesized
cgugaagaccacggacagca

SEQ ID NO: 2414 - RNA, 20 nt, Artificial Sequence
  synthesized
cugagcugcuguccgugguc

SEQ ID NO: 2415 - RNA, 20 nt, Artificial Sequence
  synthesized
cugagcuucuguccgugguc

SEQ ID NO: 2416 - RNA, 20 nt, Artificial Sequence
  synthesized
cugcuguccguggucuucac

SEQ ID NO: 2417 - RNA, 20 nt, Artificial Sequence
  synthesized
gaagaccacggacagaagcu

SEQ ID NO: 2418 - RNA, 20 nt, Artificial Sequence
  synthesized
gaagaccacggacagcagcu

SEQ ID NO: 2419 - RNA, 20 nt, Artificial Sequence
  synthesized
gaaucaaaucugagcugcug

SEQ ID NO: 2420 - RNA, 20 nt, Artificial Sequence
  synthesized
gaaucaaaucugagcuucug

SEQ ID NO: 2421 - RNA, 20 nt, Artificial Sequence
  synthesized
gacagaagcucagauuugau

SEQ ID NO: 2422 - RNA, 20 nt, Artificial Sequence
  synthesized
gcuguccguggucuucacgg

SEQ ID NO: 2423 - RNA, 20 nt, Artificial Sequence
  synthesized
ggacagaagcucagauuuga

SEQ ID NO: 2424 - RNA, 20 nt, Artificial Sequence
  synthesized
ggacagcagcucagauuuga

SEQ ID NO: 2425 - RNA, 20 nt, Artificial Sequence
  synthesized
ucaaaucugagcugcugucc

SEQ ID NO: 2426 - RNA, 20 nt, Artificial Sequence
  synthesized
ucaaaucugagcuucugucc

SEQ ID NO: 2427 - RNA, 20 nt, Artificial Sequence
  synthesized
uccgaaucaaaucugagcug

SEQ ID NO: 2428 - RNA, 20 nt, Artificial Sequence
  synthesized
ucugagcugcuguccguggu

SEQ ID NO: 2429 - RNA, 20 nt, Artificial Sequence
  synthesized
ucugagcuucuguccguggu

SEQ ID NO: 2430 - RNA, 20 nt, Artificial Sequence
  synthesized
ucuguccguggucuucacgg

SEQ ID NO: 2431 - RNA, 20 nt, Artificial Sequence
  synthesized
ugaagaccacggacagaagc

SEQ ID NO: 2432 - RNA, 20 nt, Artificial Sequence
  synthesized
ugaagaccacggacagcagc

SEQ ID NO: 2433 - RNA, 20 nt, Artificial Sequence
  synthesized
ugagcugcuguccguggucu

SEQ ID NO: 2434 - RNA, 20 nt, Artificial Sequence
  synthesized
ugagcuucuguccguggucu

SEQ ID NO: 2435 - RNA, 20 nt, Artificial Sequence
  synthesized
ugcuguccguggucuucacg

SEQ ID NO: 2436 - RNA, 20 nt, Artificial Sequence
  synthesized
uucuguccguggucuucacg

SEQ ID NO: 2437 - RNA, 20 nt, Artificial Sequence
  synthesized
acccgguacucuccccggca

SEQ ID NO: 2438 - RNA, 20 nt, Artificial Sequence
  synthesized
acucuccccggcagccccac

SEQ ID NO: 2439 - RNA, 20 nt, Artificial Sequence
  synthesized
agguguggggcugccgggga

SEQ ID NO: 2440 - RNA, 20 nt, Artificial Sequence
  synthesized
ccccggcagccccacaccuc

SEQ ID NO: 2441 - RNA, 20 nt, Artificial Sequence
  synthesized
cccggcagccccacaccucc

SEQ ID NO: 2442 - RNA, 20 nt, Artificial Sequence
  synthesized
ccggcagccccacaccuccu

SEQ ID NO: 2443 - RNA, 20 nt, Artificial Sequence
  synthesized
ccggggagaguaccggguca

SEQ ID NO: 2444 - RNA, 20 nt, Artificial Sequence
  synthesized
ccgguacucuccccggcagc

SEQ ID NO: 2445 - RNA, 20 nt, Artificial Sequence
  synthesized
cggggagaguaccgggucag

SEQ ID NO: 2446 - RNA, 20 nt, Artificial Sequence
  synthesized
cgggggagaguaccggguca

SEQ ID NO: 2447 - RNA, 20 nt, Artificial Sequence
  synthesized
cuccccggcagccccacacc

SEQ ID NO: 2448 - RNA, 20 nt, Artificial Sequence
  synthesized
cucuccccggcagccccaca

SEQ ID NO: 2449 - RNA, 20 nt, Artificial Sequence
  synthesized
cugacccgguacucuccccc

SEQ ID NO: 2450 - RNA, 20 nt, Artificial Sequence
  synthesized
cugacccgguacucuccccg

SEQ ID NO: 2451 - RNA, 20 nt, Artificial Sequence
  synthesized
gacccgguacucuccccggc

SEQ ID NO: 2452 - RNA, 20 nt, Artificial Sequence
  synthesized
gcugccggggagaguaccgg

SEQ ID NO: 2453 - RNA, 20 nt, Artificial Sequence
  synthesized
ggcagccccacaccuccuac

SEQ ID NO: 2454 - RNA, 20 nt, Artificial Sequence
  synthesized
ggcugccggggagaguaccg

SEQ ID NO: 2455 - RNA, 20 nt, Artificial Sequence
  synthesized
gggggagaguaccgggucag

SEQ ID NO: 2456 - RNA, 20 nt, Artificial Sequence
  synthesized
gguacucuccccggcagccc

SEQ ID NO: 2457 - RNA, 20 nt, Artificial Sequence
  synthesized
gguguggggcugccggggag

SEQ ID NO: 2458 - RNA, 20 nt, Artificial Sequence
  synthesized
guacucuccccggcagcccc

SEQ ID NO: 2459 - RNA, 20 nt, Artificial Sequence
  synthesized
guggggcugccggggagagu

SEQ ID NO: 2460 - RNA, 20 nt, Artificial Sequence
  synthesized
guguggggcugccggggaga

SEQ ID NO: 2461 - RNA, 20 nt, Artificial Sequence
  synthesized
uacucuccccggcagcccca

SEQ ID NO: 2462 - RNA, 20 nt, Artificial Sequence
  synthesized
uccccggcagccccacaccu

SEQ ID NO: 2463 - RNA, 20 nt, Artificial Sequence
  synthesized
ucuccccggcagccccacac

SEQ ID NO: 2464 - RNA, 20 nt, Artificial Sequence
  synthesized
ugacccgguacucuccccgg

SEQ ID NO: 2465 - RNA, 20 nt, Artificial Sequence
  synthesized
ugccggggagaguaccgggu

SEQ ID NO: 2466 - RNA, 20 nt, Artificial Sequence
  synthesized
ugcgggggagaguaccgggu

SEQ ID NO: 2467 - RNA, 20 nt, Artificial Sequence
  synthesized
uguggggcugccggggagag

SEQ ID NO: 2468 - RNA, 20 nt, Artificial Sequence
  synthesized
acugaccacaagcagccuag

SEQ ID NO: 2469 - RNA, 20 nt, Artificial Sequence
  synthesized
acuggacccacugaccacaa

SEQ ID NO: 2470 - RNA, 20 nt, Artificial Sequence
  synthesized
acuggacccagugaccacaa

SEQ ID NO: 2471 - RNA, 20 nt, Artificial Sequence
  synthesized
agacuggacccacugaccac

SEQ ID NO: 2472 - RNA, 20 nt, Artificial Sequence
  synthesized
agacuggacccagugaccac

SEQ ID NO: 2473 - RNA, 20 nt, Artificial Sequence
  synthesized
aggcugcuuguggucacugg

SEQ ID NO: 2474 - RNA, 20 nt, Artificial Sequence
  synthesized
aggcugcuuguggucagugg

SEQ ID NO: 2475 - RNA, 20 nt, Artificial Sequence
  synthesized
auuuuagacuggacccacug

SEQ ID NO: 2476 - RNA, 20 nt, Artificial Sequence
  synthesized
auuuuagacuggacccagug

SEQ ID NO: 2477 - RNA, 20 nt, Artificial Sequence
  synthesized
cacugaccacaagcagccua

SEQ ID NO: 2478 - RNA, 20 nt, Artificial Sequence
  synthesized
cagugaccacaagcagccua

SEQ ID NO: 2479 - RNA, 20 nt, Artificial Sequence
  synthesized
cccacugaccacaagcagcc

SEQ ID NO: 2480 - RNA, 20 nt, Artificial Sequence
  synthesized
cccagugaccacaagcagcc

SEQ ID NO: 2481 - RNA, 20 nt, Artificial Sequence
  synthesized
cugaccacaagcagccuagg

SEQ ID NO: 2482 - RNA, 20 nt, Artificial Sequence
  synthesized
cugcuuguggucacuggguc

SEQ ID NO: 2483 - RNA, 20 nt, Artificial Sequence
  synthesized
cugcuuguggucaguggguc

SEQ ID NO: 2484 - RNA, 20 nt, Artificial Sequence
  synthesized
cuggacccacugaccacaag

SEQ ID NO: 2485 - RNA, 20 nt, Artificial Sequence
  synthesized
cuggacccagugaccacaag

SEQ ID NO: 2486 - RNA, 20 nt, Artificial Sequence
  synthesized
cuuguggucacuggguccag

SEQ ID NO: 2487 - RNA, 20 nt, Artificial Sequence
  synthesized
cuuguggucaguggguccag

SEQ ID NO: 2488 - RNA, 20 nt, Artificial Sequence
  synthesized
gacccacugaccacaagcag

SEQ ID NO: 2489 - RNA, 20 nt, Artificial Sequence
  synthesized
gacccagugaccacaagcag

SEQ ID NO: 2490 - RNA, 20 nt, Artificial Sequence
  synthesized
gcugcuuguggucacugggu

SEQ ID NO: 2491 - RNA, 20 nt, Artificial Sequence
  synthesized
gcugcuuguggucagugggu

SEQ ID NO: 2492 - RNA, 20 nt, Artificial Sequence
  synthesized
gcuuguggucacugggucca

SEQ ID NO: 2493 - RNA, 20 nt, Artificial Sequence
  synthesized
gcuuguggucagugggucca

SEQ ID NO: 2494 - RNA, 20 nt, Artificial Sequence
  synthesized
ggacccacugaccacaagca

SEQ ID NO: 2495 - RNA, 20 nt, Artificial Sequence
  synthesized
ggacccagugaccacaagca

SEQ ID NO: 2496 - RNA, 20 nt, Artificial Sequence
  synthesized
ggucacuggguccagucuaa

SEQ ID NO: 2497 - RNA, 20 nt, Artificial Sequence
  synthesized
ggucaguggguccagucuaa

SEQ ID NO: 2498 - RNA, 20 nt, Artificial Sequence
  synthesized
gucacuggguccagucuaaa

SEQ ID NO: 2499 - RNA, 20 nt, Artificial Sequence
  synthesized
gucaguggguccagucuaaa

SEQ ID NO: 2500 - RNA, 20 nt, Artificial Sequence
  synthesized
gugaccacaagcagccuagg

SEQ ID NO: 2501 - RNA, 20 nt, Artificial Sequence
  synthesized
guggucacuggguccagucu

SEQ ID NO: 2502 - RNA, 20 nt, Artificial Sequence
  synthesized
guggucaguggguccagucu

SEQ ID NO: 2503 - RNA, 20 nt, Artificial Sequence
  synthesized
uagacuggacccacugacca

SEQ ID NO: 2504 - RNA, 20 nt, Artificial Sequence
  synthesized
uagacuggacccagugacca

SEQ ID NO: 2505 - RNA, 20 nt, Artificial Sequence
  synthesized
uaggcugcuuguggucacug

SEQ ID NO: 2506 - RNA, 20 nt, Artificial Sequence
  synthesized
uaggcugcuuguggucagug

SEQ ID NO: 2507 - RNA, 20 nt, Artificial Sequence
  synthesized
ugcuuguggucacugggucc

SEQ ID NO: 2508 - RNA, 20 nt, Artificial Sequence
  synthesized
ugcuuguggucagugggucc

SEQ ID NO: 2509 - RNA, 20 nt, Artificial Sequence
  synthesized
uggacccacugaccacaagc

SEQ ID NO: 2510 - RNA, 20 nt, Artificial Sequence
  synthesized
uggucacuggguccagucua

SEQ ID NO: 2511 - RNA, 20 nt, Artificial Sequence
  synthesized
uggucaguggguccagucua

SEQ ID NO: 2512 - RNA, 20 nt, Artificial Sequence
  synthesized
uguggucacuggguccaguc

SEQ ID NO: 2513 - RNA, 20 nt, Artificial Sequence
  synthesized
uguggucaguggguccaguc

SEQ ID NO: 2514 - RNA, 20 nt, Artificial Sequence
  synthesized
uuguggucacuggguccagu

SEQ ID NO: 2515 - RNA, 20 nt, Artificial Sequence
  synthesized
uuguggucaguggguccagu

SEQ ID NO: 2516 - RNA, 20 nt, Artificial Sequence
  synthesized
uuuagacuggacccacugac

SEQ ID NO: 2517 - RNA, 20 nt, Artificial Sequence
  synthesized
uuuagacuggacccagugac

SEQ ID NO: 2518 - RNA, 20 nt, Artificial Sequence
  synthesized
uuuuagacuggacccacuga

SEQ ID NO: 2519 - RNA, 20 nt, Artificial Sequence
  synthesized
uuuuagacuggacccaguga

SEQ ID NO: 2520 - RNA, 20 nt, Artificial Sequence
  synthesized
accuccugugcccugcucga

SEQ ID NO: 2521 - RNA, 20 nt, Artificial Sequence
  synthesized
accuccugugcccugcucgg

SEQ ID NO: 2522 - RNA, 20 nt, Artificial Sequence
  synthesized
ccgagcagggcacaggaggu

SEQ ID NO: 2523 - RNA, 20 nt, Artificial Sequence
  synthesized
ccuccccucgggccucuccc

SEQ ID NO: 2524 - RNA, 20 nt, Artificial Sequence
  synthesized
ccuccccucgggccucucuc

SEQ ID NO: 2525 - RNA, 20 nt, Artificial Sequence
  synthesized
ccugugcccugcucgagaga

SEQ ID NO: 2526 - RNA, 20 nt, Artificial Sequence
  synthesized
ccugugcccugcucgggaga

SEQ ID NO: 2527 - RNA, 20 nt, Artificial Sequence
  synthesized
cgggccucucccgagcaggg

SEQ ID NO: 2528 - RNA, 20 nt, Artificial Sequence
  synthesized
cgggccucucucgagcaggg

SEQ ID NO: 2529 - RNA, 20 nt, Artificial Sequence
  synthesized
cuccccucgggccucucccg

SEQ ID NO: 2530 - RNA, 20 nt, Artificial Sequence
  synthesized
cuccccucgggccucucucg

SEQ ID NO: 2531 - RNA, 20 nt, Artificial Sequence
  synthesized
cuccugugcccugcucgaga

SEQ ID NO: 2532 - RNA, 20 nt, Artificial Sequence
  synthesized
cuccugugcccugcucggga

SEQ ID NO: 2533 - RNA, 20 nt, Artificial Sequence
  synthesized
cucgggccucucccgagcag

SEQ ID NO: 2534 - RNA, 20 nt, Artificial Sequence
  synthesized
cucgggccucucucgagcag

SEQ ID NO: 2535 - RNA, 20 nt, Artificial Sequence
  synthesized
cucucccgagcagggcacag

SEQ ID NO: 2536 - RNA, 20 nt, Artificial Sequence
  synthesized
cucucucgagcagggcacag

SEQ ID NO: 2537 - RNA, 20 nt, Artificial Sequence
  synthesized
cugugcccugcucgggagag

SEQ ID NO: 2538 - RNA, 20 nt, Artificial Sequence
  synthesized
gcccugcucgagagaggccc

SEQ ID NO: 2539 - RNA, 20 nt, Artificial Sequence
  synthesized
gcccugcucgggagaggccc

SEQ ID NO: 2540 - RNA, 20 nt, Artificial Sequence
  synthesized
gcucgagagaggcccgaggg

SEQ ID NO: 2541 - RNA, 20 nt, Artificial Sequence
  synthesized
gcucgggagaggcccgaggg

SEQ ID NO: 2542 - RNA, 20 nt, Artificial Sequence
  synthesized
ggccucucccgagcagggca

SEQ ID NO: 2543 - RNA, 20 nt, Artificial Sequence
  synthesized
ggccucucucgagcagggca

SEQ ID NO: 2544 - RNA, 20 nt, Artificial Sequence
  synthesized
gggccucucccgagcagggc

SEQ ID NO: 2545 - RNA, 20 nt, Artificial Sequence
  synthesized
gugcccugcucgggagaggc

SEQ ID NO: 2546 - RNA, 20 nt, Artificial Sequence
  synthesized
uccccucgggccucucccga

SEQ ID NO: 2547 - RNA, 20 nt, Artificial Sequence
  synthesized
uccccucgggccucucucga

SEQ ID NO: 2548 - RNA, 20 nt, Artificial Sequence
  synthesized
ucccgagcagggcacaggag

SEQ ID NO: 2549 - RNA, 20 nt, Artificial Sequence
  synthesized
ucgagcagggcacaggaggu

SEQ ID NO: 2550 - RNA, 20 nt, Artificial Sequence
  synthesized
ucgggccucucccgagcagg

SEQ ID NO: 2551 - RNA, 20 nt, Artificial Sequence
  synthesized
ucucgagcagggcacaggag

SEQ ID NO: 2552 - RNA, 20 nt, Artificial Sequence
  synthesized
ugugcccugcucgagagagg

SEQ ID NO: 2553 - RNA, 20 nt, Artificial Sequence
  synthesized
ugugcccugcucgggagagg

SEQ ID NO: 2554 - RNA, 20 nt, Artificial Sequence
  synthesized
agcgccucauacccgcagac

SEQ ID NO: 2555 - RNA, 20 nt, Artificial Sequence
  synthesized
agcgccucguacccgcagac

SEQ ID NO: 2556 - RNA, 20 nt, Artificial Sequence
  synthesized
agguccccuggagcgccuca

SEQ ID NO: 2557 - RNA, 20 nt, Artificial Sequence
  synthesized
agguccccuggagcgccucg

SEQ ID NO: 2558 - RNA, 20 nt, Artificial Sequence
  synthesized
auacccgcagaccgcagacc

SEQ ID NO: 2559 - RNA, 20 nt, Artificial Sequence
  synthesized
cauacccgcagaccgcagac

SEQ ID NO: 2560 - RNA, 20 nt, Artificial Sequence
  synthesized
ccccuggagcgccucauacc

SEQ ID NO: 2561 - RNA, 20 nt, Artificial Sequence
  synthesized
ccccuggagcgccucguacc

SEQ ID NO: 2562 - RNA, 20 nt, Artificial Sequence
  synthesized
ccucauacccgcagaccgca

SEQ ID NO: 2563 - RNA, 20 nt, Artificial Sequence
  synthesized
ccucguacccgcagaccgca

SEQ ID NO: 2564 - RNA, 20 nt, Artificial Sequence
  synthesized
ccuggagcgccucauacccg

SEQ ID NO: 2565 - RNA, 20 nt, Artificial Sequence
  synthesized
ccuggagcgccucguacccg

SEQ ID NO: 2566 - RNA, 20 nt, Artificial Sequence
  synthesized
cgaggcgcuccaggggaccu

SEQ ID NO: 2567 - RNA, 20 nt, Artificial Sequence
  synthesized
cgccucauacccgcagaccg

SEQ ID NO: 2568 - RNA, 20 nt, Artificial Sequence
  synthesized
cgccucguacccgcagaccg

SEQ ID NO: 2569 - RNA, 20 nt, Artificial Sequence
  synthesized
cggucugcggguacgaggcg

SEQ ID NO: 2570 - RNA, 20 nt, Artificial Sequence
  synthesized
cggucugcggguaugaggcg

SEQ ID NO: 2571 - RNA, 20 nt, Artificial Sequence
  synthesized
cguacccgcagaccgcagac

SEQ ID NO: 2572 - RNA, 20 nt, Artificial Sequence
  synthesized
cucauacccgcagaccgcag

SEQ ID NO: 2573 - RNA, 20 nt, Artificial Sequence
  synthesized
cucguacccgcagaccgcag

SEQ ID NO: 2574 - RNA, 20 nt, Artificial Sequence
  synthesized
cugcggucugcggguacgag

SEQ ID NO: 2575 - RNA, 20 nt, Artificial Sequence
  synthesized
cugcggucugcggguaugag

SEQ ID NO: 2576 - RNA, 20 nt, Artificial Sequence
  synthesized
gagcgccucauacccgcaga

SEQ ID NO: 2577 - RNA, 20 nt, Artificial Sequence
  synthesized
gagcgccucguacccgcaga

SEQ ID NO: 2578 - RNA, 20 nt, Artificial Sequence
  synthesized
gcggucugcggguacgaggc

SEQ ID NO: 2579 - RNA, 20 nt, Artificial Sequence
  synthesized
gcggucugcggguaugaggc

SEQ ID NO: 2580 - RNA, 20 nt, Artificial Sequence
  synthesized
ggagcgccucauacccgcag

SEQ ID NO: 2581 - RNA, 20 nt, Artificial Sequence
  synthesized
ggagcgccucguacccgcag

SEQ ID NO: 2582 - RNA, 20 nt, Artificial Sequence
  synthesized
ggguaugaggcgcuccaggg

SEQ ID NO: 2583 - RNA, 20 nt, Artificial Sequence
  synthesized
gguacgaggcgcuccagggg

SEQ ID NO: 2584 - RNA, 20 nt, Artificial Sequence
  synthesized
gguaugaggcgcuccagggg

SEQ ID NO: 2585 - RNA, 20 nt, Artificial Sequence
  synthesized
ggucugcggguacgaggcgc

SEQ ID NO: 2586 - RNA, 20 nt, Artificial Sequence
  synthesized
ggucugcggguaugaggcgc

SEQ ID NO: 2587 - RNA, 20 nt, Artificial Sequence
  synthesized
ggucugcggucugcggguac

SEQ ID NO: 2588 - RNA, 20 nt, Artificial Sequence
  synthesized
ggucugcggucugcggguau

SEQ ID NO: 2589 - RNA, 20 nt, Artificial Sequence
  synthesized
guacccgcagaccgcagacc

SEQ ID NO: 2590 - RNA, 20 nt, Artificial Sequence
  synthesized
guccccuggagcgccucaua

SEQ ID NO: 2591 - RNA, 20 nt, Artificial Sequence
  synthesized
guccccuggagcgccucgua

SEQ ID NO: 2592 - RNA, 20 nt, Artificial Sequence
  synthesized
gucugcggguacgaggcgcu

SEQ ID NO: 2593 - RNA, 20 nt, Artificial Sequence
  synthesized
gucugcggguaugaggcgcu

SEQ ID NO: 2594 - RNA, 20 nt, Artificial Sequence
  synthesized
uacgaggcgcuccaggggac

SEQ ID NO: 2595 - RNA, 20 nt, Artificial Sequence
  synthesized
uaugaggcgcuccaggggac

SEQ ID NO: 2596 - RNA, 20 nt, Artificial Sequence
  synthesized
ucauacccgcagaccgcaga

SEQ ID NO: 2597 - RNA, 20 nt, Artificial Sequence
  synthesized
uccccuggagcgccucauac

SEQ ID NO: 2598 - RNA, 20 nt, Artificial Sequence
  synthesized
uccccuggagcgccucguac

SEQ ID NO: 2599 - RNA, 20 nt, Artificial Sequence
  synthesized
ucguacccgcagaccgcaga

SEQ ID NO: 2600 - RNA, 20 nt, Artificial Sequence
  synthesized
ucugcggguacgaggcgcuc

SEQ ID NO: 2601 - RNA, 20 nt, Artificial Sequence
  synthesized
ucugcggguaugaggcgcuc

SEQ ID NO: 2602 - RNA, 20 nt, Artificial Sequence
  synthesized
ugaggcgcuccaggggaccu

SEQ ID NO: 2603 - RNA, 20 nt, Artificial Sequence
  synthesized
ugcggucugcggguacgagg

SEQ ID NO: 2604 - RNA, 20 nt, Artificial Sequence
  synthesized
ugcggucugcggguaugagg

SEQ ID NO: 2605 - RNA, 20 nt, Artificial Sequence
  synthesized
aaccaagucagaaggaacca

SEQ ID NO: 2606 - RNA, 20 nt, Artificial Sequence
  synthesized
aauuugguuccuucugacuu

SEQ ID NO: 2607 - RNA, 20 nt, Artificial Sequence
  synthesized
accaagucagaaggaaccaa

SEQ ID NO: 2608 - RNA, 20 nt, Artificial Sequence
  synthesized
ccaagucagaaggaaccaaa

SEQ ID NO: 2609 - RNA, 20 nt, Artificial Sequence
  synthesized
cuaauuugguuccuucugac

SEQ ID NO: 2610 - RNA, 20 nt, Artificial Sequence
  synthesized
aauuguucauugagucggcu

SEQ ID NO: 2611 - RNA, 20 nt, Artificial Sequence
  synthesized
aauuguucauugauucggcu

SEQ ID NO: 2612 - RNA, 20 nt, Artificial Sequence
  synthesized
agccgaaucaaugaacaauu

SEQ ID NO: 2613 - RNA, 20 nt, Artificial Sequence
  synthesized
agccgacucaaugaacaauu

SEQ ID NO: 2614 - RNA, 20 nt, Artificial Sequence
  synthesized
agucggcucacugaugagcc

SEQ ID NO: 2615 - RNA, 20 nt, Artificial Sequence
  synthesized
agugagccgaaucaaugaac

SEQ ID NO: 2616 - RNA, 20 nt, Artificial Sequence
  synthesized
agugagccgacucaaugaac

SEQ ID NO: 2617 - RNA, 20 nt, Artificial Sequence
  synthesized
aucagugagccgaaucaaug

SEQ ID NO: 2618 - RNA, 20 nt, Artificial Sequence
  synthesized
aucagugagccgacucaaug

SEQ ID NO: 2619 - RNA, 20 nt, Artificial Sequence
  synthesized
auucggcucacugaugagcc

SEQ ID NO: 2620 - RNA, 20 nt, Artificial Sequence
  synthesized
auugagucggcucacugaug

SEQ ID NO: 2621 - RNA, 20 nt, Artificial Sequence
  synthesized
auugauucggcucacugaug

SEQ ID NO: 2622 - RNA, 20 nt, Artificial Sequence
  synthesized
auuguucauugagucggcuc

SEQ ID NO: 2623 - RNA, 20 nt, Artificial Sequence
  synthesized
auuguucauugauucggcuc

SEQ ID NO: 2624 - RNA, 20 nt, Artificial Sequence
  synthesized
cagugagccgaaucaaugaa

SEQ ID NO: 2625 - RNA, 20 nt, Artificial Sequence
  synthesized
cagugagccgacucaaugaa

SEQ ID NO: 2626 - RNA, 20 nt, Artificial Sequence
  synthesized
caucagugagccgaaucaau

SEQ ID NO: 2627 - RNA, 20 nt, Artificial Sequence
  synthesized
caucagugagccgacucaau

SEQ ID NO: 2628 - RNA, 20 nt, Artificial Sequence
  synthesized
cauugagucggcucacugau

SEQ ID NO: 2629 - RNA, 20 nt, Artificial Sequence
  synthesized
cauugauucggcucacugau

SEQ ID NO: 2630 - RNA, 20 nt, Artificial Sequence
  synthesized
ccgaaucaaugaacaauuaa

SEQ ID NO: 2631 - RNA, 20 nt, Artificial Sequence
  synthesized
ccgacucaaugaacaauuaa

SEQ ID NO: 2632 - RNA, 20 nt, Artificial Sequence
  synthesized
cgaaucaaugaacaauuaac

SEQ ID NO: 2633 - RNA, 20 nt, Artificial Sequence
  synthesized
cgacucaaugaacaauuaac

SEQ ID NO: 2634 - RNA, 20 nt, Artificial Sequence
  synthesized
gagucggcucacugaugagc

SEQ ID NO: 2635 - RNA, 20 nt, Artificial Sequence
  synthesized
gauucggcucacugaugagc

SEQ ID NO: 2636 - RNA, 20 nt, Artificial Sequence
  synthesized
gccgaaucaaugaacaauua

SEQ ID NO: 2637 - RNA, 20 nt, Artificial Sequence
  synthesized
gccgacucaaugaacaauua

SEQ ID NO: 2638 - RNA, 20 nt, Artificial Sequence
  synthesized
gcucaucagugagccgaauc

SEQ ID NO: 2639 - RNA, 20 nt, Artificial Sequence
  synthesized
gcucaucagugagccgacuc

SEQ ID NO: 2640 - RNA, 20 nt, Artificial Sequence
  synthesized
ggcucaucagugagccgaau

SEQ ID NO: 2641 - RNA, 20 nt, Artificial Sequence
  synthesized
ggcucaucagugagccgacu

SEQ ID NO: 2642 - RNA, 20 nt, Artificial Sequence
  synthesized
gggcucaucagugagccgaa

SEQ ID NO: 2643 - RNA, 20 nt, Artificial Sequence
  synthesized
gggcucaucagugagccgac

SEQ ID NO: 2644 - RNA, 20 nt, Artificial Sequence
  synthesized
gucggcucacugaugagccc

SEQ ID NO: 2645 - RNA, 20 nt, Artificial Sequence
  synthesized
guuaauuguucauugagucg

SEQ ID NO: 2646 - RNA, 20 nt, Artificial Sequence
  synthesized
guuaauuguucauugauucg

SEQ ID NO: 2647 - RNA, 20 nt, Artificial Sequence
  synthesized
guucauugagucggcucacu

SEQ ID NO: 2648 - RNA, 20 nt, Artificial Sequence
  synthesized
guucauugauucggcucacu

SEQ ID NO: 2649 - RNA, 20 nt, Artificial Sequence
  synthesized
uaauuguucauugagucggc

SEQ ID NO: 2650 - RNA, 20 nt, Artificial Sequence
  synthesized
uaauuguucauugauucggc

SEQ ID NO: 2651 - RNA, 20 nt, Artificial Sequence
  synthesized
ucagugagccgaaucaauga

SEQ ID NO: 2652 - RNA, 20 nt, Artificial Sequence
  synthesized
ucagugagccgacucaauga

SEQ ID NO: 2653 - RNA, 20 nt, Artificial Sequence
  synthesized
ugagccgaaucaaugaacaa

SEQ ID NO: 2654 - RNA, 20 nt, Artificial Sequence
  synthesized
ugagccgacucaaugaacaa

SEQ ID NO: 2655 - RNA, 20 nt, Artificial Sequence
  synthesized
ugagucggcucacugaugag

SEQ ID NO: 2656 - RNA, 20 nt, Artificial Sequence
  synthesized
ugauucggcucacugaugag

SEQ ID NO: 2657 - RNA, 20 nt, Artificial Sequence
  synthesized
uguuaauuguucauugaguc

SEQ ID NO: 2658 - RNA, 20 nt, Artificial Sequence
  synthesized
uuaauuguucauugagucgg

SEQ ID NO: 2659 - RNA, 20 nt, Artificial Sequence
  synthesized
uuaauuguucauugauucgg

SEQ ID NO: 2660 - RNA, 20 nt, Artificial Sequence
  synthesized
uucggcucacugaugagccc

SEQ ID NO: 2661 - RNA, 20 nt, Artificial Sequence
  synthesized
uugagucggcucacugauga

SEQ ID NO: 2662 - RNA, 20 nt, Artificial Sequence
  synthesized
uugauucggcucacugauga

SEQ ID NO: 2663 - RNA, 20 nt, Artificial Sequence
  synthesized
uuguucauugagucggcuca

SEQ ID NO: 2664 - RNA, 20 nt, Artificial Sequence
  synthesized
uuguucauugauucggcuca

SEQ ID NO: 2665 - RNA, 20 nt, Artificial Sequence
  synthesized
aaaggaccugcgcuggguca

SEQ ID NO: 2666 - RNA, 20 nt, Artificial Sequence
  synthesized
aaaggaccugcucuggguca

SEQ ID NO: 2667 - RNA, 20 nt, Artificial Sequence
  synthesized
aaggaccugcgcugggucac

SEQ ID NO: 2668 - RNA, 20 nt, Artificial Sequence
  synthesized
aaggaccugcucugggucac

SEQ ID NO: 2669 - RNA, 20 nt, Artificial Sequence
  synthesized
acagugacccagagcagguc

SEQ ID NO: 2670 - RNA, 20 nt, Artificial Sequence
  synthesized
acagugacccagcgcagguc

SEQ ID NO: 2671 - RNA, 20 nt, Artificial Sequence
  synthesized
accugcgcugggucacuguc

SEQ ID NO: 2672 - RNA, 20 nt, Artificial Sequence
  synthesized
accugcucugggucacuguc

SEQ ID NO: 2673 - RNA, 20 nt, Artificial Sequence
  synthesized
acuaaaggaccugcgcuggg

SEQ ID NO: 2674 - RNA, 20 nt, Artificial Sequence
  synthesized
acuaaaggaccugcucuggg

SEQ ID NO: 2675 - RNA, 20 nt, Artificial Sequence
  synthesized
agagcagguccuuuagugac

SEQ ID NO: 2676 - RNA, 20 nt, Artificial Sequence
  synthesized
agcgcagguccuuuagugac

SEQ ID NO: 2677 - RNA, 20 nt, Artificial Sequence
  synthesized
aggaccugcgcugggucacu

SEQ ID NO: 2678 - RNA, 20 nt, Artificial Sequence
  synthesized
aggaccugcucugggucacu

SEQ ID NO: 2679 - RNA, 20 nt, Artificial Sequence
  synthesized
agugacccagagcagguccu

SEQ ID NO: 2680 - RNA, 20 nt, Artificial Sequence
  synthesized
agugacccagcgcagguccu

SEQ ID NO: 2681 - RNA, 20 nt, Artificial Sequence
  synthesized
cacuaaaggaccugcgcugg

SEQ ID NO: 2682 - RNA, 20 nt, Artificial Sequence
  synthesized
cacuaaaggaccugcucugg

SEQ ID NO: 2683 - RNA, 20 nt, Artificial Sequence
  synthesized
cagugacccagagcaggucc

SEQ ID NO: 2684 - RNA, 20 nt, Artificial Sequence
  synthesized
cagugacccagcgcaggucc

SEQ ID NO: 2685 - RNA, 20 nt, Artificial Sequence
  synthesized
ccagagcagguccuuuagug

SEQ ID NO: 2686 - RNA, 20 nt, Artificial Sequence
  synthesized
ccagcgcagguccuuuagug

SEQ ID NO: 2687 - RNA, 20 nt, Artificial Sequence
  synthesized
cccagagcagguccuuuagu

SEQ ID NO: 2688 - RNA, 20 nt, Artificial Sequence
  synthesized
cccagcgcagguccuuuagu

SEQ ID NO: 2689 - RNA, 20 nt, Artificial Sequence
  synthesized
ccugcgcugggucacugucc

SEQ ID NO: 2690 - RNA, 20 nt, Artificial Sequence
  synthesized
ccugcucugggucacugucc

SEQ ID NO: 2691 - RNA, 20 nt, Artificial Sequence
  synthesized
cgcugggucacuguccccua

SEQ ID NO: 2692 - RNA, 20 nt, Artificial Sequence
  synthesized
cuaaaggaccugcgcugggu

SEQ ID NO: 2693 - RNA, 20 nt, Artificial Sequence
  synthesized
cuaaaggaccugcucugggu

SEQ ID NO: 2694 - RNA, 20 nt, Artificial Sequence
  synthesized
cucugggucacuguccccua

SEQ ID NO: 2695 - RNA, 20 nt, Artificial Sequence
  synthesized
cugcgcugggucacuguccc

SEQ ID NO: 2696 - RNA, 20 nt, Artificial Sequence
  synthesized
cugcucugggucacuguccc

SEQ ID NO: 2697 - RNA, 20 nt, Artificial Sequence
  synthesized
gacagugacccagagcaggu

SEQ ID NO: 2698 - RNA, 20 nt, Artificial Sequence
  synthesized
gacagugacccagcgcaggu

SEQ ID NO: 2699 - RNA, 20 nt, Artificial Sequence
  synthesized
gacccagagcagguccuuua

SEQ ID NO: 2700 - RNA, 20 nt, Artificial Sequence
  synthesized
gacccagcgcagguccuuua

SEQ ID NO: 2701 - RNA, 20 nt, Artificial Sequence
  synthesized
gaccugcgcugggucacugu

SEQ ID NO: 2702 - RNA, 20 nt, Artificial Sequence
  synthesized
gaccugcucugggucacugu

SEQ ID NO: 2703 - RNA, 20 nt, Artificial Sequence
  synthesized
gagcagguccuuuagugacc

SEQ ID NO: 2704 - RNA, 20 nt, Artificial Sequence
  synthesized
gcgcagguccuuuagugacc

SEQ ID NO: 2705 - RNA, 20 nt, Artificial Sequence
  synthesized
gcgcugggucacuguccccu

SEQ ID NO: 2706 - RNA, 20 nt, Artificial Sequence
  synthesized
gcucugggucacuguccccu

SEQ ID NO: 2707 - RNA, 20 nt, Artificial Sequence
  synthesized
gcugggucacuguccccuac

SEQ ID NO: 2708 - RNA, 20 nt, Artificial Sequence
  synthesized
ggacagugacccagagcagg

SEQ ID NO: 2709 - RNA, 20 nt, Artificial Sequence
  synthesized
ggacagugacccagcgcagg

SEQ ID NO: 2710 - RNA, 20 nt, Artificial Sequence
  synthesized
ggaccugcgcugggucacug

SEQ ID NO: 2711 - RNA, 20 nt, Artificial Sequence
  synthesized
ggaccugcucugggucacug

SEQ ID NO: 2712 - RNA, 20 nt, Artificial Sequence
  synthesized
gggacagugacccagagcag

SEQ ID NO: 2713 - RNA, 20 nt, Artificial Sequence
  synthesized
gggacagugacccagcgcag

SEQ ID NO: 2714 - RNA, 20 nt, Artificial Sequence
  synthesized
ggggacagugacccagagca

SEQ ID NO: 2715 - RNA, 20 nt, Artificial Sequence
  synthesized
ggggacagugacccagcgca

SEQ ID NO: 2716 - RNA, 20 nt, Artificial Sequence
  synthesized
gugacccagagcagguccuu

SEQ ID NO: 2717 - RNA, 20 nt, Artificial Sequence
  synthesized
gugacccagcgcagguccuu

SEQ ID NO: 2718 - RNA, 20 nt, Artificial Sequence
  synthesized
uaaaggaccugcgcuggguc

SEQ ID NO: 2719 - RNA, 20 nt, Artificial Sequence
  synthesized
uaaaggaccugcucuggguc

SEQ ID NO: 2720 - RNA, 20 nt, Artificial Sequence
  synthesized
uaggggacagugacccagag

SEQ ID NO: 2721 - RNA, 20 nt, Artificial Sequence
  synthesized
uaggggacagugacccagcg

SEQ ID NO: 2722 - RNA, 20 nt, Artificial Sequence
  synthesized
ucacuaaaggaccugcgcug

SEQ ID NO: 2723 - RNA, 20 nt, Artificial Sequence
  synthesized
ucacuaaaggaccugcucug

SEQ ID NO: 2724 - RNA, 20 nt, Artificial Sequence
  synthesized
ucugggucacuguccccuac

SEQ ID NO: 2725 - RNA, 20 nt, Artificial Sequence
  synthesized
acuccgcuaauccacccuca

SEQ ID NO: 2726 - RNA, 20 nt, Artificial Sequence
  synthesized
agacuccgcuaauccacccu

SEQ ID NO: 2727 - RNA, 20 nt, Artificial Sequence
  synthesized
aggguggauuagcggagucu

SEQ ID NO: 2728 - RNA, 20 nt, Artificial Sequence
  synthesized
aguggggguugaggguggau

SEQ ID NO: 2729 - RNA, 20 nt, Artificial Sequence
  synthesized
auccacccucaacccccacu

SEQ ID NO: 2730 - RNA, 20 nt, Artificial Sequence
  synthesized
cagagacuccgcuaauccac

SEQ ID NO: 2731 - RNA, 20 nt, Artificial Sequence
  synthesized
ccagagacuccgcuaaucca

SEQ ID NO: 2732 - RNA, 20 nt, Artificial Sequence
  synthesized
ccgcuaauccacccucaacc

SEQ ID NO: 2733 - RNA, 20 nt, Artificial Sequence
  synthesized
cgcuaauccacccucaaccc

SEQ ID NO: 2734 - RNA, 20 nt, Artificial Sequence
  synthesized
cuaauccacccucaaccccc

SEQ ID NO: 2735 - RNA, 20 nt, Artificial Sequence
  synthesized
cuccgcuaauccacccucaa

SEQ ID NO: 2736 - RNA, 20 nt, Artificial Sequence
  synthesized
gaauuagcggagucucugga

SEQ ID NO: 2737 - RNA, 20 nt, Artificial Sequence
  synthesized
gacuccgcuaauccacccuc

SEQ ID NO: 2738 - RNA, 20 nt, Artificial Sequence
  synthesized
gagacuccgcuaauccaccc

SEQ ID NO: 2739 - RNA, 20 nt, Artificial Sequence
  synthesized
gaggguggauuagcggaguc

SEQ ID NO: 2740 - RNA, 20 nt, Artificial Sequence
  synthesized
gcuaauccacccucaacccc

SEQ ID NO: 2741 - RNA, 20 nt, Artificial Sequence
  synthesized
ggauuagcggagucucugga

SEQ ID NO: 2742 - RNA, 20 nt, Artificial Sequence
  synthesized
ggguugaggguggauuagcg

SEQ ID NO: 2743 - RNA, 20 nt, Artificial Sequence
  synthesized
gguugaggguggauuagcgg

SEQ ID NO: 2744 - RNA, 20 nt, Artificial Sequence
  synthesized
guggauuagcggagucucug

SEQ ID NO: 2745 - RNA, 20 nt, Artificial Sequence
  synthesized
guugaggguggauuagcgga

SEQ ID NO: 2746 - RNA, 20 nt, Artificial Sequence
  synthesized
uaauccacccucaaccccca

SEQ ID NO: 2747 - RNA, 20 nt, Artificial Sequence
  synthesized
uccagagacuccgcuaaucc

SEQ ID NO: 2748 - RNA, 20 nt, Artificial Sequence
  synthesized
uccgcuaauccacccucaac

SEQ ID NO: 2749 - RNA, 20 nt, Artificial Sequence
  synthesized
ugaggguggauuagcggagu

SEQ ID NO: 2750 - RNA, 20 nt, Artificial Sequence
  synthesized
uggggguugaggguggauua

SEQ ID NO: 2751 - RNA, 20 nt, Artificial Sequence
  synthesized
uuccagagacuccgcuaauc

SEQ ID NO: 2752 - RNA, 20 nt, Artificial Sequence
  synthesized
uugaggguggauuagcggag

SEQ ID NO: 2753 - RNA, 20 nt, Artificial Sequence
  synthesized
agcccgggccacauggggga

SEQ ID NO: 2754 - RNA, 20 nt, Artificial Sequence
  synthesized
augcagggagcccgggccac

SEQ ID NO: 2755 - RNA, 20 nt, Artificial Sequence
  synthesized
augcagggagccugggccac

SEQ ID NO: 2756 - RNA, 20 nt, Artificial Sequence
  synthesized
caggcucccugcaugagccc

SEQ ID NO: 2757 - RNA, 20 nt, Artificial Sequence
  synthesized
ccaggcucccugcaugagcc

SEQ ID NO: 2758 - RNA, 20 nt, Artificial Sequence
  synthesized
ccauguggcccaggcucccu

SEQ ID NO: 2759 - RNA, 20 nt, Artificial Sequence
  synthesized
ccauguggcccgggcucccu

SEQ ID NO: 2760 - RNA, 20 nt, Artificial Sequence
  synthesized
cccaggcucccugcaugagc

SEQ ID NO: 2761 - RNA, 20 nt, Artificial Sequence
  synthesized
cccauguggcccgggcuccc

SEQ ID NO: 2762 - RNA, 20 nt, Artificial Sequence
  synthesized
ccccauguggcccaggcucc

SEQ ID NO: 2763 - RNA, 20 nt, Artificial Sequence
  synthesized
ccccauguggcccgggcucc

SEQ ID NO: 2764 - RNA, 20 nt, Artificial Sequence
  synthesized
cccccauguggcccaggcuc

SEQ ID NO: 2765 - RNA, 20 nt, Artificial Sequence
  synthesized
cccccauguggcccgggcuc

SEQ ID NO: 2766 - RNA, 20 nt, Artificial Sequence
  synthesized
cccgggcucccugcaugagc

SEQ ID NO: 2767 - RNA, 20 nt, Artificial Sequence
  synthesized
ccgggcucccugcaugagcc

SEQ ID NO: 2768 - RNA, 20 nt, Artificial Sequence
  synthesized
cgggcucccugcaugagccc

SEQ ID NO: 2769 - RNA, 20 nt, Artificial Sequence
  synthesized
cucaugcagggagcccgggc

SEQ ID NO: 2770 - RNA, 20 nt, Artificial Sequence
  synthesized
cuggucccccauguggcccg

SEQ ID NO: 2771 - RNA, 20 nt, Artificial Sequence
  synthesized
gagcccgggccacauggggg

SEQ ID NO: 2772 - RNA, 20 nt, Artificial Sequence
  synthesized
gagccugggccacauggggg

SEQ ID NO: 2773 - RNA, 20 nt, Artificial Sequence
  synthesized
gcccaggcucccugcaugag

SEQ ID NO: 2774 - RNA, 20 nt, Artificial Sequence
  synthesized
gcccgggccacaugggggac

SEQ ID NO: 2775 - RNA, 20 nt, Artificial Sequence
  synthesized
gcccgggcucccugcaugag

SEQ ID NO: 2776 - RNA, 20 nt, Artificial Sequence
  synthesized
gccugggccacaugggggac

SEQ ID NO: 2777 - RNA, 20 nt, Artificial Sequence
  synthesized
gcucaugcagggagcccggg

SEQ ID NO: 2778 - RNA, 20 nt, Artificial Sequence
  synthesized
gcucaugcagggagccuggg

SEQ ID NO: 2779 - RNA, 20 nt, Artificial Sequence
  synthesized
ggagcccgggccacaugggg

SEQ ID NO: 2780 - RNA, 20 nt, Artificial Sequence
  synthesized
ggagccugggccacaugggg

SEQ ID NO: 2781 - RNA, 20 nt, Artificial Sequence
  synthesized
ggcccgggcucccugcauga

SEQ ID NO: 2782 - RNA, 20 nt, Artificial Sequence
  synthesized
ggcucaugcagggagcccgg

SEQ ID NO: 2783 - RNA, 20 nt, Artificial Sequence
  synthesized
ggcucaugcagggagccugg

SEQ ID NO: 2784 - RNA, 20 nt, Artificial Sequence
  synthesized
ggucccccauguggcccagg

SEQ ID NO: 2785 - RNA, 20 nt, Artificial Sequence
  synthesized
ggucccccauguggcccggg

SEQ ID NO: 2786 - RNA, 20 nt, Artificial Sequence
  synthesized
gucccccauguggcccaggc

SEQ ID NO: 2787 - RNA, 20 nt, Artificial Sequence
  synthesized
gucccccauguggcccgggc

SEQ ID NO: 2788 - RNA, 20 nt, Artificial Sequence
  synthesized
guggcccaggcucccugcau

SEQ ID NO: 2789 - RNA, 20 nt, Artificial Sequence
  synthesized
guggcccgggcucccugcau

SEQ ID NO: 2790 - RNA, 20 nt, Artificial Sequence
  synthesized
ucaugcagggagcccgggcc

SEQ ID NO: 2791 - RNA, 20 nt, Artificial Sequence
  synthesized
ucccccauguggcccgggcu

SEQ ID NO: 2792 - RNA, 20 nt, Artificial Sequence
  synthesized
uggcccaggcucccugcaug

SEQ ID NO: 2793 - RNA, 20 nt, Artificial Sequence
  synthesized
uggcccgggcucccugcaug

SEQ ID NO: 2794 - RNA, 20 nt, Artificial Sequence
  synthesized
uggucccccauguggcccag

SEQ ID NO: 2795 - RNA, 20 nt, Artificial Sequence
  synthesized
uggucccccauguggcccgg

SEQ ID NO: 2796 - RNA, 20 nt, Artificial Sequence
  synthesized
aaagccgaggaagggcuguu

SEQ ID NO: 2797 - RNA, 20 nt, Artificial Sequence
  synthesized
acagcccuuccucggcuucg

SEQ ID NO: 2798 - RNA, 20 nt, Artificial Sequence
  synthesized
acagcccuuccucggcuuug

SEQ ID NO: 2799 - RNA, 20 nt, Artificial Sequence
  synthesized
accagucggccuccaaagcc

SEQ ID NO: 2800 - RNA, 20 nt, Artificial Sequence
  synthesized
accagucggccuccgaagcc

SEQ ID NO: 2801 - RNA, 20 nt, Artificial Sequence
  synthesized
agcccuuccucggcuucgga

SEQ ID NO: 2802 - RNA, 20 nt, Artificial Sequence
  synthesized
agcccuuccucggcuuugga

SEQ ID NO: 2803 - RNA, 20 nt, Artificial Sequence
  synthesized
aggcaaccagucggccucca

SEQ ID NO: 2804 - RNA, 20 nt, Artificial Sequence
  synthesized
aggcaaccagucggccuccg

SEQ ID NO: 2805 - RNA, 20 nt, Artificial Sequence
  synthesized
agucggccuccgaagccgag

SEQ ID NO: 2806 - RNA, 20 nt, Artificial Sequence
  synthesized
caaagccgaggaagggcugu

SEQ ID NO: 2807 - RNA, 20 nt, Artificial Sequence
  synthesized
caaccagucggccuccaaag

SEQ ID NO: 2808 - RNA, 20 nt, Artificial Sequence
  synthesized
caaccagucggccuccgaag

SEQ ID NO: 2809 - RNA, 20 nt, Artificial Sequence
  synthesized
ccaaagccgaggaagggcug

SEQ ID NO: 2810 - RNA, 20 nt, Artificial Sequence
  synthesized
cccuuccucggcuucggagg

SEQ ID NO: 2811 - RNA, 20 nt, Artificial Sequence
  synthesized
cccuuccucggcuuuggagg

SEQ ID NO: 2812 - RNA, 20 nt, Artificial Sequence
  synthesized
ccgaagccgaggaagggcug

SEQ ID NO: 2813 - RNA, 20 nt, Artificial Sequence
  synthesized
ccuccaaagccgaggaaggg

SEQ ID NO: 2814 - RNA, 20 nt, Artificial Sequence
  synthesized
ccuccgaagccgaggaaggg

SEQ ID NO: 2815 - RNA, 20 nt, Artificial Sequence
  synthesized
cggcuucggaggccgacugg

SEQ ID NO: 2816 - RNA, 20 nt, Artificial Sequence
  synthesized
cggcuuuggaggccgacugg

SEQ ID NO: 2817 - RNA, 20 nt, Artificial Sequence
  synthesized
cuccaaagccgaggaagggc

SEQ ID NO: 2818 - RNA, 20 nt, Artificial Sequence
  synthesized
cuccgaagccgaggaagggc

SEQ ID NO: 2819 - RNA, 20 nt, Artificial Sequence
  synthesized
cucggcuucggaggccgacu

SEQ ID NO: 2820 - RNA, 20 nt, Artificial Sequence
  synthesized
cucggcuuuggaggccgacu

SEQ ID NO: 2821 - RNA, 20 nt, Artificial Sequence
  synthesized
cuuccucggcuucggaggcc

SEQ ID NO: 2822 - RNA, 20 nt, Artificial Sequence
  synthesized
cuucggaggccgacugguug

SEQ ID NO: 2823 - RNA, 20 nt, Artificial Sequence
  synthesized
cuuuggaggccgacugguug

SEQ ID NO: 2824 - RNA, 20 nt, Artificial Sequence
  synthesized
gcaaccagucggccuccaaa

SEQ ID NO: 2825 - RNA, 20 nt, Artificial Sequence
  synthesized
gcaaccagucggccuccgaa

SEQ ID NO: 2826 - RNA, 20 nt, Artificial Sequence
  synthesized
gcccuuccucggcuucggag

SEQ ID NO: 2827 - RNA, 20 nt, Artificial Sequence
  synthesized
gcccuuccucggcuuuggag

SEQ ID NO: 2828 - RNA, 20 nt, Artificial Sequence
  synthesized
gccuccaaagccgaggaagg

SEQ ID NO: 2829 - RNA, 20 nt, Artificial Sequence
  synthesized
gccuccgaagccgaggaagg

SEQ ID NO: 2830 - RNA, 20 nt, Artificial Sequence
  synthesized
gcuucggaggccgacugguu

SEQ ID NO: 2831 - RNA, 20 nt, Artificial Sequence
  synthesized
gcuuuggaggccgacugguu

SEQ ID NO: 2832 - RNA, 20 nt, Artificial Sequence
  synthesized
ggcaaccagucggccuccaa

SEQ ID NO: 2833 - RNA, 20 nt, Artificial Sequence
  synthesized
ggcaaccagucggccuccga

SEQ ID NO: 2834 - RNA, 20 nt, Artificial Sequence
  synthesized
ggccuccaaagccgaggaag

SEQ ID NO: 2835 - RNA, 20 nt, Artificial Sequence
  synthesized
ggccuccgaagccgaggaag

SEQ ID NO: 2836 - RNA, 20 nt, Artificial Sequence
  synthesized
ggcuucggaggccgacuggu

SEQ ID NO: 2837 - RNA, 20 nt, Artificial Sequence
  synthesized
ggcuuuggaggccgacuggu

SEQ ID NO: 2838 - RNA, 20 nt, Artificial Sequence
  synthesized
gucggccuccaaagccgagg

SEQ ID NO: 2839 - RNA, 20 nt, Artificial Sequence
  synthesized
gucggccuccgaagccgagg

SEQ ID NO: 2840 - RNA, 20 nt, Artificial Sequence
  synthesized
uccaaagccgaggaagggcu

SEQ ID NO: 2841 - RNA, 20 nt, Artificial Sequence
  synthesized
uccgaagccgaggaagggcu

SEQ ID NO: 2842 - RNA, 20 nt, Artificial Sequence
  synthesized
uccucggcuucggaggccga

SEQ ID NO: 2843 - RNA, 20 nt, Artificial Sequence
  synthesized
uccucggcuuuggaggccga

SEQ ID NO: 2844 - RNA, 20 nt, Artificial Sequence
  synthesized
ucggaggccgacugguugcc

SEQ ID NO: 2845 - RNA, 20 nt, Artificial Sequence
  synthesized
ucggcuucggaggccgacug

SEQ ID NO: 2846 - RNA, 20 nt, Artificial Sequence
  synthesized
ucggcuuuggaggccgacug

SEQ ID NO: 2847 - RNA, 20 nt, Artificial Sequence
  synthesized
uuccucggcuucggaggccg

SEQ ID NO: 2848 - RNA, 20 nt, Artificial Sequence
  synthesized
uuccucggcuuuggaggccg

SEQ ID NO: 2849 - RNA, 20 nt, Artificial Sequence
  synthesized
uucggaggccgacugguugc

SEQ ID NO: 2850 - RNA, 20 nt, Artificial Sequence
  synthesized
uuggaggccgacugguugcc

SEQ ID NO: 2851 - RNA, 20 nt, Artificial Sequence
  synthesized
uuuggaggccgacugguugc

SEQ ID NO: 2852 - RNA, 20 nt, Artificial Sequence
  synthesized
acucagcccagugaggggug

SEQ ID NO: 2853 - RNA, 20 nt, Artificial Sequence
  synthesized
acugggcugagucagauggc

SEQ ID NO: 2854 - RNA, 20 nt, Artificial Sequence
  synthesized
aggccaccccucacugggcu

SEQ ID NO: 2855 - RNA, 20 nt, Artificial Sequence
  synthesized
agggagggguggccuggggg

SEQ ID NO: 2856 - RNA, 20 nt, Artificial Sequence
  synthesized
agugagggguggccuggggg

SEQ ID NO: 2857 - RNA, 20 nt, Artificial Sequence
  synthesized
caccccucacugggcugagu

SEQ ID NO: 2858 - RNA, 20 nt, Artificial Sequence
  synthesized
cacugggcugagucagaugg

SEQ ID NO: 2859 - RNA, 20 nt, Artificial Sequence
  synthesized
cagggagggguggccugggg

SEQ ID NO: 2860 - RNA, 20 nt, Artificial Sequence
  synthesized
cagugagggguggccugggg

SEQ ID NO: 2861 - RNA, 20 nt, Artificial Sequence
  synthesized
ccaccccucacugggcugag

SEQ ID NO: 2862 - RNA, 20 nt, Artificial Sequence
  synthesized
ccaccccucccugggcugag

SEQ ID NO: 2863 - RNA, 20 nt, Artificial Sequence
  synthesized
cccaggccaccccucacugg

SEQ ID NO: 2864 - RNA, 20 nt, Artificial Sequence
  synthesized
ccccaggccaccccucacug

SEQ ID NO: 2865 - RNA, 20 nt, Artificial Sequence
  synthesized
cccucacugggcugagucag

SEQ ID NO: 2866 - RNA, 20 nt, Artificial Sequence
  synthesized
cccucccugggcugagucag

SEQ ID NO: 2867 - RNA, 20 nt, Artificial Sequence
  synthesized
cccugggcugagucagaugg

SEQ ID NO: 2868 - RNA, 20 nt, Artificial Sequence
  synthesized
ccugggcugagucagauggc

SEQ ID NO: 2869 - RNA, 20 nt, Artificial Sequence
  synthesized
cucacugggcugagucagau

SEQ ID NO: 2870 - RNA, 20 nt, Artificial Sequence
  synthesized
cucagcccagugaggggugg

SEQ ID NO: 2871 - RNA, 20 nt, Artificial Sequence
  synthesized
cucccugggcugagucagau

SEQ ID NO: 2872 - RNA, 20 nt, Artificial Sequence
  synthesized
cugacucagcccagggaggg

SEQ ID NO: 2873 - RNA, 20 nt, Artificial Sequence
  synthesized
cugacucagcccagugaggg

SEQ ID NO: 2874 - RNA, 20 nt, Artificial Sequence
  synthesized
gccaucugacucagcccagg

SEQ ID NO: 2875 - RNA, 20 nt, Artificial Sequence
  synthesized
gccaucugacucagcccagu

SEQ ID NO: 2876 - RNA, 20 nt, Artificial Sequence
  synthesized
ggagggguggccugggggac

SEQ ID NO: 2877 - RNA, 20 nt, Artificial Sequence
  synthesized
gggagggguggccuggggga

SEQ ID NO: 2878 - RNA, 20 nt, Artificial Sequence
  synthesized
gucccccaggccaccccuca

SEQ ID NO: 2879 - RNA, 20 nt, Artificial Sequence
  synthesized
gucccccaggccaccccucc

SEQ ID NO: 2880 - RNA, 20 nt, Artificial Sequence
  synthesized
gugagggguggccuggggga

SEQ ID NO: 2881 - RNA, 20 nt, Artificial Sequence
  synthesized
ucacugggcugagucagaug

SEQ ID NO: 2882 - RNA, 20 nt, Artificial Sequence
  synthesized
ucagcccagggagggguggc

SEQ ID NO: 2883 - RNA, 20 nt, Artificial Sequence
  synthesized
ucagcccagugagggguggc

SEQ ID NO: 2884 - RNA, 20 nt, Artificial Sequence
  synthesized
ucccugggcugagucagaug

SEQ ID NO: 2885 - RNA, 20 nt, Artificial Sequence
  synthesized
ugagggguggccugggggac

SEQ ID NO: 2886 - RNA, 20 nt, Artificial Sequence
  synthesized
aaacccuuccccuauuaccg

SEQ ID NO: 2887 - RNA, 20 nt, Artificial Sequence
  synthesized
aagggauuguggggccugcc

SEQ ID NO: 2888 - RNA, 20 nt, Artificial Sequence
  synthesized
aaggguuuguggggccugcc

SEQ ID NO: 2889 - RNA, 20 nt, Artificial Sequence
  synthesized
aauaggggaaggguuugugg

SEQ ID NO: 2890 - RNA, 20 nt, Artificial Sequence
  synthesized
aaucccuuccccuauuaccg

SEQ ID NO: 2891 - RNA, 20 nt, Artificial Sequence
  synthesized
acaaacccuuccccuauuac

SEQ ID NO: 2892 - RNA, 20 nt, Artificial Sequence
  synthesized
acaaucccuuccccuauuac

SEQ ID NO: 2893 - RNA, 20 nt, Artificial Sequence
  synthesized
acccuuccccuauuaccgcc

SEQ ID NO: 2894 - RNA, 20 nt, Artificial Sequence
  synthesized
aggccccacaaacccuuccc

SEQ ID NO: 2895 - RNA, 20 nt, Artificial Sequence
  synthesized
aggccccacaaucccuuccc

SEQ ID NO: 2896 - RNA, 20 nt, Artificial Sequence
  synthesized
agggauuguggggccugccc

SEQ ID NO: 2897 - RNA, 20 nt, Artificial Sequence
  synthesized
aggggaaggguuuguggggc

SEQ ID NO: 2898 - RNA, 20 nt, Artificial Sequence
  synthesized
aggggcaggccccacaaacc

SEQ ID NO: 2899 - RNA, 20 nt, Artificial Sequence
  synthesized
aggggcaggccccacaaucc

SEQ ID NO: 2900 - RNA, 20 nt, Artificial Sequence
  synthesized
aggguuuguggggccugccc

SEQ ID NO: 2901 - RNA, 20 nt, Artificial Sequence
  synthesized
auaggggaagggauuguggg

SEQ ID NO: 2902 - RNA, 20 nt, Artificial Sequence
  synthesized
auaggggaaggguuuguggg

SEQ ID NO: 2903 - RNA, 20 nt, Artificial Sequence
  synthesized
caaacccuuccccuauuacc

SEQ ID NO: 2904 - RNA, 20 nt, Artificial Sequence
  synthesized
caaucccuuccccuauuacc

SEQ ID NO: 2905 - RNA, 20 nt, Artificial Sequence
  synthesized
cacaaacccuuccccuauua

SEQ ID NO: 2906 - RNA, 20 nt, Artificial Sequence
  synthesized
cacaaucccuuccccuauua

SEQ ID NO: 2907 - RNA, 20 nt, Artificial Sequence
  synthesized
caggccccacaaacccuucc

SEQ ID NO: 2908 - RNA, 20 nt, Artificial Sequence
  synthesized
caggccccacaaucccuucc

SEQ ID NO: 2909 - RNA, 20 nt, Artificial Sequence
  synthesized
ccacaaacccuuccccuauu

SEQ ID NO: 2910 - RNA, 20 nt, Artificial Sequence
  synthesized
ccacaaucccuuccccuauu

SEQ ID NO: 2911 - RNA, 20 nt, Artificial Sequence
  synthesized
accaccguccccaggugaac

SEQ ID NO: 2912 - RNA, 20 nt, Artificial Sequence
  synthesized
acucaccaccguccccaggu

SEQ ID NO: 2913 - RNA, 20 nt, Artificial Sequence
  synthesized
auccccaggugaaccauucc

SEQ ID NO: 2914 - RNA, 20 nt, Artificial Sequence
  synthesized
caccaccguccccaggugaa

SEQ ID NO: 2915 - RNA, 20 nt, Artificial Sequence
  synthesized
cauccccaggugaaccauuc

SEQ ID NO: 2916 - RNA, 20 nt, Artificial Sequence
  synthesized
ccaccguccccaggugaacc

SEQ ID NO: 2917 - RNA, 20 nt, Artificial Sequence
  synthesized
ccauccccaggugaaccauu

SEQ ID NO: 2918 - RNA, 20 nt, Artificial Sequence
  synthesized
ccguccccaggugaaccauu

SEQ ID NO: 2919 - RNA, 20 nt, Artificial Sequence
  synthesized
cguccccaggugaaccauuc

SEQ ID NO: 2920 - RNA, 20 nt, Artificial Sequence
  synthesized
cucaccaccguccccaggug

SEQ ID NO: 2921 - RNA, 20 nt, Artificial Sequence
  synthesized
gaaugguucaccuggggacg

SEQ ID NO: 2922 - RNA, 20 nt, Artificial Sequence
  synthesized
guccccaggugaaccauucc

SEQ ID NO: 2923 - RNA, 20 nt, Artificial Sequence
  synthesized
guucaccuggggacgguggu

SEQ ID NO: 2924 - RNA, 20 nt, Artificial Sequence
  synthesized
ucaccuggggacggugguga

SEQ ID NO: 2925 - RNA, 20 nt, Artificial Sequence
  synthesized
uucaccuggggacgguggug

SEQ ID NO: 2926 - RNA, 20 nt, Artificial Sequence
  synthesized
acagcugaggagaagggagg

SEQ ID NO: 2927 - RNA, 20 nt, Artificial Sequence
  synthesized
ccucccuucuccucagcugc

SEQ ID NO: 2928 - RNA, 20 nt, Artificial Sequence
  synthesized
ccucccuucuccucagcugu

SEQ ID NO: 2929 - RNA, 20 nt, Artificial Sequence
  synthesized
cucccuucuccucagcugca

SEQ ID NO: 2930 - RNA, 20 nt, Artificial Sequence
  synthesized
cucccuucuccucagcugua

SEQ ID NO: 2931 - RNA, 20 nt, Artificial Sequence
  synthesized
gacuacagcugaggagaagg

SEQ ID NO: 2932 - RNA, 20 nt, Artificial Sequence
  synthesized
gacugcagcugaggagaagg

SEQ ID NO: 2933 - RNA, 20 nt, Artificial Sequence
  synthesized
gcagcugaggagaagggagg

SEQ ID NO: 2934 - RNA, 20 nt, Artificial Sequence
  synthesized
ucccuucuccucagcugcag

SEQ ID NO: 2935 - RNA, 20 nt, Artificial Sequence
  synthesized
ucccuucuccucagcuguag

SEQ ID NO: 2936 - RNA, 20 nt, Artificial Sequence
  synthesized
ugcagcugaggagaagggag

SEQ ID NO: 2937 - RNA, 20 nt, Artificial Sequence
  synthesized
ccccacaaacccuuccccua

SEQ ID NO: 2938 - RNA, 20 nt, Artificial Sequence
  synthesized
ccccacaaucccuuccccua

SEQ ID NO: 2939 - RNA, 20 nt, Artificial Sequence
  synthesized
cgguaauaggggaagggauu

SEQ ID NO: 2940 - RNA, 20 nt, Artificial Sequence
  synthesized
cgguaauaggggaaggguuu

SEQ ID NO: 2941 - RNA, 20 nt, Artificial Sequence
  synthesized
gaagggauuguggggccugc

SEQ ID NO: 2942 - RNA, 20 nt, Artificial Sequence
  synthesized
gaaggguuuguggggccugc

SEQ ID NO: 2943 - RNA, 20 nt, Artificial Sequence
  synthesized
gaggggcaggccccacaaac

SEQ ID NO: 2944 - RNA, 20 nt, Artificial Sequence
  synthesized
gaggggcaggccccacaauc

SEQ ID NO: 2945 - RNA, 20 nt, Artificial Sequence
  synthesized
gcaggccccacaaacccuuc

SEQ ID NO: 2946 - RNA, 20 nt, Artificial Sequence
  synthesized
gccccacaaacccuuccccu

SEQ ID NO: 2947 - RNA, 20 nt, Artificial Sequence
  synthesized
gccccacaaucccuuccccu

SEQ ID NO: 2948 - RNA, 20 nt, Artificial Sequence
  synthesized
ggaagggauuguggggccug

SEQ ID NO: 2949 - RNA, 20 nt, Artificial Sequence
  synthesized
ggaaggguuuguggggccug

SEQ ID NO: 2950 - RNA, 20 nt, Artificial Sequence
  synthesized
ggaggggcaggccccacaaa

SEQ ID NO: 2951 - RNA, 20 nt, Artificial Sequence
  synthesized
ggaggggcaggccccacaau

SEQ ID NO: 2952 - RNA, 20 nt, Artificial Sequence
  synthesized
ggauuguggggccugccccu

SEQ ID NO: 2953 - RNA, 20 nt, Artificial Sequence
  synthesized
ggcaggccccacaaacccuu

SEQ ID NO: 2954 - RNA, 20 nt, Artificial Sequence
  synthesized
ggcaggccccacaaucccuu

SEQ ID NO: 2955 - RNA, 20 nt, Artificial Sequence
  synthesized
ggccccacaaacccuucccc

SEQ ID NO: 2956 - RNA, 20 nt, Artificial Sequence
  synthesized
ggcgguaauaggggaaggga

SEQ ID NO: 2957 - RNA, 20 nt, Artificial Sequence
  synthesized
ggcgguaauaggggaagggu

SEQ ID NO: 2958 - RNA, 20 nt, Artificial Sequence
  synthesized
gggaagggauuguggggccu

SEQ ID NO: 2959 - RNA, 20 nt, Artificial Sequence
  synthesized
gggaaggguuuguggggccu

SEQ ID NO: 2960 - RNA, 20 nt, Artificial Sequence
  synthesized
gggcaggccccacaaacccu

SEQ ID NO: 2961 - RNA, 20 nt, Artificial Sequence
  synthesized
gggcaggccccacaaucccu

SEQ ID NO: 2962 - RNA, 20 nt, Artificial Sequence
  synthesized
ggggaagggauuguggggcc

SEQ ID NO: 2963 - RNA, 20 nt, Artificial Sequence
  synthesized
ggggaaggguuuguggggcc

SEQ ID NO: 2964 - RNA, 20 nt, Artificial Sequence
  synthesized
ggggcaggccccacaaaccc

SEQ ID NO: 2965 - RNA, 20 nt, Artificial Sequence
  synthesized
ggggcaggccccacaauccc

SEQ ID NO: 2966 - RNA, 20 nt, Artificial Sequence
  synthesized
ggguuuguggggccugcccc

SEQ ID NO: 2967 - RNA, 20 nt, Artificial Sequence
  synthesized
gguuuguggggccugccccu

SEQ ID NO: 2968 - RNA, 20 nt, Artificial Sequence
  synthesized
uaggggaagggauugugggg

SEQ ID NO: 2969 - RNA, 20 nt, Artificial Sequence
  synthesized
uaggggaaggguuugugggg

SEQ ID NO: 2970 - RNA, 20 nt, Artificial Sequence
  synthesized
ucccuuccccuauuaccgcc

SEQ ID NO: 2971 - RNA, 20 nt, Artificial Sequence
  synthesized
uuuguggggccugccccucc

SEQ ID NO: 2972 - RNA, 20 nt, Artificial Sequence
  synthesized
aagcacugggccaugaaucc

SEQ ID NO: 2973 - RNA, 20 nt, Artificial Sequence
  synthesized
aagggagggguacugcuucg

SEQ ID NO: 2974 - RNA, 20 nt, Artificial Sequence
  synthesized
aagggagggguacugcuucu

SEQ ID NO: 2975 - RNA, 20 nt, Artificial Sequence
  synthesized
aaucagaagcaguaccccuc

SEQ ID NO: 2976 - RNA, 20 nt, Artificial Sequence
  synthesized
aauccgaagcaguaccccuc

SEQ ID NO: 2977 - RNA, 20 nt, Artificial Sequence
  synthesized
agaagcaguaccccucccuu

SEQ ID NO: 2978 - RNA, 20 nt, Artificial Sequence
  synthesized
agcacugggccaugaaucag

SEQ ID NO: 2979 - RNA, 20 nt, Artificial Sequence
  synthesized
agcacugggccaugaauccg

SEQ ID NO: 2980 - RNA, 20 nt, Artificial Sequence
  synthesized
agggagggguacugcuucgg

SEQ ID NO: 2981 - RNA, 20 nt, Artificial Sequence
  synthesized
agggagggguacugcuucug

SEQ ID NO: 2982 - RNA, 20 nt, Artificial Sequence
  synthesized
agggguacugcuucggauuc

SEQ ID NO: 2983 - RNA, 20 nt, Artificial Sequence
  synthesized
agggguacugcuucugauuc

SEQ ID NO: 2984 - RNA, 20 nt, Artificial Sequence
  synthesized
aucagaagcaguaccccucc

SEQ ID NO: 2985 - RNA, 20 nt, Artificial Sequence
  synthesized
auccgaagcaguaccccucc

SEQ ID NO: 2986 - RNA, 20 nt, Artificial Sequence
  synthesized
augaaucagaagcaguaccc

SEQ ID NO: 2987 - RNA, 20 nt, Artificial Sequence
  synthesized
augaauccgaagcaguaccc

SEQ ID NO: 2988 - RNA, 20 nt, Artificial Sequence
  synthesized
cacugggccaugaaucagaa

SEQ ID NO: 2989 - RNA, 20 nt, Artificial Sequence
  synthesized
cacugggccaugaauccgaa

SEQ ID NO: 2990 - RNA, 20 nt, Artificial Sequence
  synthesized
cagaagcaguaccccucccu

SEQ ID NO: 2991 - RNA, 20 nt, Artificial Sequence
  synthesized
caugaaucagaagcaguacc

SEQ ID NO: 2992 - RNA, 20 nt, Artificial Sequence
  synthesized
caugaauccgaagcaguacc

SEQ ID NO: 2993 - RNA, 20 nt, Artificial Sequence
  synthesized
ccaugaaucagaagcaguac

SEQ ID NO: 2994 - RNA, 20 nt, Artificial Sequence
  synthesized
ccaugaauccgaagcaguac

SEQ ID NO: 2995 - RNA, 20 nt, Artificial Sequence
  synthesized
ccgaagcaguaccccucccu

SEQ ID NO: 2996 - RNA, 20 nt, Artificial Sequence
  synthesized
cgaagcaguaccccucccuu

SEQ ID NO: 2997 - RNA, 20 nt, Artificial Sequence
  synthesized
cggauucauggcccagugcu

SEQ ID NO: 2998 - RNA, 20 nt, Artificial Sequence
  synthesized
cugauucauggcccagugcu

SEQ ID NO: 2999 - RNA, 20 nt, Artificial Sequence
  synthesized
cugggccaugaaucagaagc

SEQ ID NO: 3000 - RNA, 20 nt, Artificial Sequence
  synthesized
cugggccaugaauccgaagc

SEQ ID NO: 3001 - RNA, 20 nt, Artificial Sequence
  synthesized
cuucggauucauggcccagu

SEQ ID NO: 3002 - RNA, 20 nt, Artificial Sequence
  synthesized
gaaucagaagcaguaccccu

SEQ ID NO: 3003 - RNA, 20 nt, Artificial Sequence
  synthesized
gaauccgaagcaguaccccu

SEQ ID NO: 3004 - RNA, 20 nt, Artificial Sequence
  synthesized
gccaugaaucagaagcagua

SEQ ID NO: 3005 - RNA, 20 nt, Artificial Sequence
  synthesized
gccaugaauccgaagcagua

SEQ ID NO: 3006 - RNA, 20 nt, Artificial Sequence
  synthesized
gcuucggauucauggcccag

SEQ ID NO: 3007 - RNA, 20 nt, Artificial Sequence
  synthesized
gcuucugauucauggcccag

SEQ ID NO: 3008 - RNA, 20 nt, Artificial Sequence
  synthesized
ggagggguacugcuucggau

SEQ ID NO: 3009 - RNA, 20 nt, Artificial Sequence
  synthesized
ggagggguacugcuucugau

SEQ ID NO: 3010 - RNA, 20 nt, Artificial Sequence
  synthesized
ggccaugaaucagaagcagu

SEQ ID NO: 3011 - RNA, 20 nt, Artificial Sequence
  synthesized
ccagaagcagcuccucugug

SEQ ID NO: 3012 - RNA, 20 nt, Artificial Sequence
  synthesized
cccagaagcagcugcucugu

SEQ ID NO: 3013 - RNA, 20 nt, Artificial Sequence
  synthesized
gauaaagugaagaucgcaca

SEQ ID NO: 3014 - RNA, 20 nt, Artificial Sequence
  synthesized
ggauaaagugaagaucgcac

SEQ ID NO: 3015 - RNA, 20 nt, Artificial Sequence
  synthesized
ucccagaagcagcuccucug

The invention claimed is:

1. An isolated guide RNA (gRNA) that targets a mutant Inosine Monophosphate Dehydrogenase 1 (IMPDH1) allele, wherein the gRNA comprises a CRISPR RNA (crRNA) consisting of the nucleic acid sequence of SEQ ID NO: 159, 160, 161, 274, 276, 282, 3011, 3012, 3013, 3014, or 3015.

2. A method for inactivating a mutant IMPDH1 allele, the method comprising:
   (a) delivering the composition gRNA of claim 1 and a CRISPR nuclease to an isolated human cell that comprises a mutant IMPDH1 allele and a functional IMPDH1 allele; and
   (b) culturing the cell obtained in step a)
   such that the mutant IMPDH1 allele is inactivated and the functional IMPDH1 allele remains intact.

3. The method of claim 2, wherein the mutant IMPDH1 allele is inactivated by a frameshift mutation.

4. The method of claim 3, wherein the frameshift mutation creates an early stop codon in the mutant IMPDH1 allele.

5. The method of claim 3, wherein the frameshift mutation results in nonsense-mediated mRNA decay of a transcript of the mutant IMPDH1 allele.

6. The method of claim 2, wherein the inactivated mutant IMPDH1 allele expresses a truncated protein and the intact functional IMPDH1 allele expresses a functional protein.

* * * * *